United States Patent 10,233,495 (METHODS AND COMPOSITIONS FOR SCREENING AND TREATING DEVELOPMENTAL DISORDERS) - sequence listing, part 154

SEQ ID NO: 822 - DNA, 442548 bp, Homo sapiens
ggaaaatgaatgaatgaagccctcgttcaggccacaactttaataatattaaagaggagatattttcttttggtattctagctaaagacttttgggatgagatggatagggatattaacaaatgtgtgtgtttttaaaaaatatacatattatgaaataaaacatctggaagacctccataactcaatgaaccaatattctacaaatgacccatgtgtgaagtggcagaatcatgaatggataaaaggtttgtctgaagcttaagataaacctgtgggttttaaatgtgtagactttaaaaattcagtgataggatttcagattccacactaccttatctttgagaagctattgatgatcaagttttgtcatcaaaggagaacattcacagttatttgaaaagattactaaaatactttttctaactatgtatctttgtgaggctagattttcttcatctactttaacctgaacaacataaggaatgctgatctgagaaactggttgtctcctcataagtcagatattaacaagatttgtaaacatgtaaaacagtacactcttcccctatgaaaatttttctgtttgaaaaaatatatcccatttttcataaaattatgttatttatgtaaaatgtagtggatttatctttaaaattattaaatagtcaaaaacttcattttaattttagaaaatatagaaatattaattttaatttattacagcgttaaatttaatgcaatataatttaattacagaacatgtagacatttacaatgcacaaaaacaaaagttcctctaggcccttaatcattgttaagagggcaaaagaggcagggcgcgacggctcatgcctgtaatcccagcactttgtgaggccgaggcgggcggatcacctgaagtcaggagttcgagaccagcctggccaacatggtgaaaacccgtctctactaaaaatacaaaaattagccgtgtgtggtggcacgtgcctgtagtcccagctactcgggaggctgagataggaaaattgcttgaacccgggaggtggaggctgcagtgagctgagatcacgccactacactccagcctgggcaagacagagagagactctgtctcaaaacaaaacaaaaaaagaaggcaaaggaatcctgtgaccaacatgtttcacaatttctgcttgatgttataaatgatggcactttcccccggaaatctctgcagttttatcagtctccctccctgtctgaccacctcaatccttttctatctctgctgactcaaaatggttgaagcaataaagacagcatctgtaacaagatgtacttagattcaggacctctgggctgggtcagtttgagggcttaacaatgtcctccagtagccaggttctctgtgtcttgcagtcctgtgtttcataagtcatcggcccatttcactcatggcagaagatggctgctgtacctccagccatcacagcctcatctactaatatctggaggcccaattaggatcatttcctcccagattttctcttttaagagcaaagacattctttcagggatcaagcccaattcctcatccctgatttacacacagcccctaactaaaagtaatcaggtgtaggccaggcatggcagctcacacttgtaattccaacactttgagaggctgagtcaggaggatcacctaaggtcaggagttcaagaccaacctggccaacatggtgaaacctcgtctctactaaaaatacaaaattagccaggcatggtggtgggcgcctgtaatcccagctacttgggaggctgaggcaggagaatcgcttgaacctgggaggtggaggttgcagtgagccaagatcgtgccatttcactccagcctgggcaacagagtgagactccctctcaaaaaaaaaaaaaaaaaaaaaaagcctgagaaagcatgaaggaaccctgggaaaaaatacaggctccaccaacaataaggaaaaatgatggttgactgggtagccagtagcatgtgctgcaaatcatttgcttattttgtgtcaagttgtttgccaatgtagctctttatatattatatattattatgttactctttaccaaaatataaaatattgagatgtaattgtagttgtgacccacacacatacatgtaaatgcatgtattgcaaatgtgttctctcattctgtatttgtcttcaattcttagaacctttgtcacaatcatgtcgtgcaatcaagtagcttggcacaaacatctgttctgtgccttctgagtttgattttttgttgttgttgtttgagacagagtcttgctctgtcacccaggctggagtgccgatcatggctcactgcagccttgaactcgcaggctcaagcaatcctcccaccttagcctcctgagtagctgggactacaggcgtgtgccaacactctcagctaatttttttatttttattttttgtaaagatgaggggaatctcactatattggccaggccggtcttgaattcctgagctgaggcgatcctcccactttagcctcctgagtagctgggacaacaggcgtgtgccaacactctcggctaattttttaaaaattttttgtaaagtcagagggatctcactatattggccaggctgttcttgaactcctgagctcacgtgatcctcctgcctttacctcccaaagtgctgggatggcaggcatgagccaccatgcccagctgcctgccgggtttcaatccttcctttcccagcacacatgtaattttaaaaaggtcttgtaactaactctccaataaagttgtcccaggcatataaatgtcttgacgttttcttcaaatgcctccctaggaaaattggcacacacctattcccggcaacagggaggagagaaaggtttactctgaatgcacccatgacaaagcttacctgctgccaagctctccatggcttcctggagaccaacacacacaggaacagaagcccggcaacccccgggggaagatgcctcctccgggtttaaaaacagagctacccttttgcccggggatcatgagggttgccttgtgacttagtgccttatactctgctttcggagcaccaattctcagtggaacgggagaaacaggcgggtgaggaggggtggggtgatttatggggcagagaatggtgcaacacctacccttgtttgtgttgggagaccgaggcctcctccatgccctaaacatgctgtttaaacatccctgcaatttcgccaacgtctctttctctctggctgcctcaacccttttctatctctgccaaatccatgctccactgtctccggccctcctggctccagctacccctccccaacaccctcaaatctcagaaatgcaagcagtgcctctcaagcctgcgcattaggaactcctggaggcctggttcacatagcggggttggaggaagccccgagacgcagggttctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcctgagattctattttggagacccctgttccagagagaagagcagtgctcctgacacttggtgggtggggcccagggacgctgctcaacaccctgcagtgcacaggacgccccccacagtcattcaacttaaatgttattagtgataaagttgagaaagactctatctattgtctatctatgtatccatctatccacccattcatctatcatcatttatctattacctatgtatcatttatctattatgtctatacatctagccatccatcatccatcatcattatttattatctatcatttatctaatatctgtcttcctgtctatcttcatcatcatcatcatcatcatcatcaatctcttatctatttatcatctatctccatatatgtatgtatctatgtatctctatatctatgtatcatctatttatcacctatctatctctctatcctatctatcatctatctgtccattcatcctatctcatctatcatctacctatgtatcatctatcatgcatctactgatctatttatctatccattatctatctatttatttatcatctatctaaacagtggcttacagcctaagaatgattctgcccctgctcctaccaggggacactgtgcaatgtttgaggtcagttttaattgtcactactggaaagtgtgccaatggcacccggcagatggagcccagggatactgctcaacaccctacagtgcacaggatgggcccacctcagagaatccagccctgaatgccacaaacgccttggtgaaaaactccagtagtaacttccatctaaccttgggaaagggatcaggttgacagtcacatcattctgaacagtccaggaggcaggagctgtctgagtcttttgtaaatgcccctcttgttagaacactcataagaccctttcccgtaggaggatcctcccttacccagagcaagagcacagcactccacggtttccctgctggagcaatgagaagccaacacaggccccatggaacgagttggcagcacaaggctgtgcagacatctggcgactattggagccaacaaggagaaagcatagaagctgggagagtctccccttccttgcacaagaactgagacttccttggaggggccagcttcatcctggcatttctcttctttggggctggcatccagaggatagaaaactgaggtcgtactggcaaagggggctccgccggggcacttcttggctcctaaggatttccccaatgcctcaggggctggacggatttgaaagtggaccccctatggaaaatgatacagagatttctcaaagaactaaaattttatctaccagttgatctaacaattccactacaaggtattcacccaaaggaaaacaagtcattatatcaaaaacacacctgcactcatatgtttattacagcaccattcacaatagcaaagatacggagtcaacccaggtgctcatcgacaggtgattggatacagaaaatgtgatttatgtgtacaatggaatcatattcagccatgcaaaagaatgaaattctatcttttgcagcaacatggatgaaactggaggccattatcttaagtcaaataactgagaaaaagaacgtcaattaccacgtgttctcactcataagtgggagctaaataatatgtccacatggacatagagagtggattaatagacactggagatacaaaagggtgagagagtgggaggatggtggagaatgagaaattacttaataggtaccatgtacactattcaggtgatgcttaccctggaaacccagacttcaccacaactcagtatatctatgtaacaaaattgcactttaccccataaatttacacaaataaaataaaataaatcagtaaaattggatatgtcaacctgtttaaaacaaacgaatgcagaaaaaaaacatgttgtaataacatataaaaataaataaagatggcttcttgatgtttaatatgccctgcagatatcttacaaagccccagtagtcacgagttaaattcttgcctgtagcctgctggaggtcagagatagcctccactgtttatgtacagctctggccccatctatgaagtagagctaaaaacaccaccgatacctgtccccaaggctgagctgatgcaggaacagccctcagcacagtgcctggtatccacagaccatcgatcatcctaggtattcatctagatcaggaaggcctgactgtagcttgcgttgattgccattgacagtttcggcaagaatctgggttcctttgctgtctctttcggatggacacgtgaaggctcttctccaagtaagttcactcattcgactcatgcactcatacatgcatgcactcacaccatcatcactcattcaactcatacatgcatgccctcacacagtcatcactcattcaactcatacatgcatgccctcacacagtcatcactcattcaactcatacatgcatgccctcacacagtcatcactcattcaactcatacatgcatgcactcacacagtcatcactcattcaactcatacatgcatgcactcacagtcatcactcattcaactcatgaactcatacatgcttgcattcacacattcattgattcattcacttaattcactcatgcatgcatgcatgcattcacactttcacttattcattcatgcatccattaacttgtccatgcattcaattcattcattcactcatacataatacattaattcctgaagtgtatgcagtcttcactcattcactcgtgtgtgtgcattaacacacatgctagtttgttcagctcattcctgtactcatacatatttattcactcagtcattcggccacgtattcacttgtcatgtattctcttcattcactcacacacacatccattcctgtataaatgcatgccttcacgtgctcaatcaatcctgcatgcatgaattcactcactcatgcaggcatgaactcacttgttcactcactcattcatgcactcactcatgcttgtacgaattcgcttatttactcattcatacactcatgcaggcatgaactcacttgttcactcattcgtgcactcatgcatgcatgaattcacttgtttactcactcatacatgcacttatacatgcatgaattcacttcttaagtcattcatgcactcaatcacgtatgaattcgcttgttcactcattcatgcactcactcatgcaggcatgaattcgcttgtttattcactcatgcagtcactcatgcatgcataagttcacttgttcacttattcatgcactcactcatgtatgcatgaattcacctttcacccattcatgcactatgcatgcatgaattcacttgttcactcaatcattcatgcattcaactcattcattcactcattcatagattcatgccttcacgcatgcatgcatgcattcacctatattttccacacagtcacacctccattcacgcatctatctctaaattcattcatacatgcattggctcgttcatgccttcaactcatgcattcatgtgtgaatgcattcattccctccttggcgcaaacattgattcaatggttcattcatttcctggcctgctcattcatgagtagttgtttgttcattcacgcctcacatgcattcacgcatacatgcactcacgcatacatgcactcaccgcgtgcgtacagccactcgctcgctatgcattcaacagctgaagcctgaaaccctcatttattctttctttcgtgcactcattcattcattcagtttatgcgtgtaagtacgcgcacgtgcatttttcatgcattcgacaagatcgcgtataagccctgccttctccctctgggaggcttccagagcggcctccactcttgctgcgcgctggccttgggcccagggccttaagtcatcgcaaacgtttactttggggctggctgattaaaggttaaatgtccaaacctagaaaccgccgactgccgaaggggccgcggcgggcgaggggcggggcgcgggcgtggatcgcagcccccggcggttcccgggtctctcttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagccatgtggcctccttccagtgtgtgtttgcctatttcctgcgatatcaggcttatattttatattaaaccaagggtagggcctttctattttattttcggccttttctattgtattttgtttttaaaatagtaagcatcgggctgggcgtggtggctcactcctgtaatgccagcactttgggaggctgaaacaggtggatcacgtgaggccaggagttcaagaccagcctgggcaacatggtgaggccccgtctctaccaaaaacacaaaaatattagccgggcatggtggcacacgtctgcaatcccagctactggggaggctgaggcacaagagttgcttgagctggggaggcagaggttgcagagagctgagatcacaccaccatactccagccagggcgacagagtgaggatctgtctcaaaaaaataaataaataaaatataataataataataataagcattatttgagctggaattgcaaggtaaaattttaacagtaaacaataaacatactttattttatttttgatttaaaatgttttttaactgtcatgtaataattgtacatatttatggggcatgtagtaaagttgcagtacacgtcatgtctactgatcaggtcacgggaattagcatatccatcatctccaacctgtaccattttttgtgttgggaacattcagtattctccttctatatatatatttgaaactatataatatatgattttgagctgtagtcatcctatagtgctatataccagtgatccccaacctttttggcaccagggaccagtttcatggaagacaatttttccagaaaccaggctggggggatggttttgggatgattcaggtgcatgacacttattgtgcactttatttctgttatgattacattgtaacatgcaatgaaataattatacaactcagcatcatgtagaatcagtgggagccctgagcttgttttcctgcaactggacagtcccatccaggggtgacaggagacagatcatcaggcattcgattctcataaggagcacgcaacctagatcccctcacatgcacagttcacggtaaggtttgcactgctatgggaatcttacgcggccgccgatctgcaggaggcagagctcgggtggtaatgggagcgatggcgagcggctatcaatacagatgaagctttgctcactcgccgctactcacctcctgctgtgcggcccagttcctaataggccatggaccagcactggtctgcagcccaggggttggggacccctgctatagaacactagaactaccttaaaaaaaaaaaacccaaaactggatctcatagaagtaagaactagaacagaggataccagaggtcaggaagggtagggagaaggggtgatggggagagatttgttaaagggtacaaaattacagctagataggaggagtcagttccaacaataaatttaaattatcagatggatttttcagaattgctggtcacagtgaaatgcatagaactgtttacttctaactttttgcgatcttgcaggatctctttaggaaaggtacccattttctgaactttgctttgtcagtttcattcattcattcgtcatatgcttattgagtgctctctttatacccagctgtgtgacatgggacaaatcaatacaccataagtttgggaatatacacttttttccacgagaaatcctcattgtcagaagtatcttcattcaatgggcacaatatgctgtgtatctcactgggtggctgtcaggggccaccgagagtgtcgttaaaaatgggcatgttgattgacgtctcatgtctccctagaatatataaaaccaaactgtgctttggccaccttgggcacatgtcgccaggacctcccgaggccgtgtcgcaggtgtgtgtcctcaaccttggcaaaagaaactttctaaactaactgagacctgtctcagattttcagggttcacaggtacagtgctgagtacgtgggtgggggtacctcactaccatagaaaataccctagtgacaaaccggcacgtgtaccccttagacctaacataaaagttgaaattatttaaaaataaataaataaatattatgagattattatcttgtggcaagtggaaatgatgtgggaaggaaaggatttctagatctgtcgaattggcagggtggattgatgcctacagatccacaggaataagttatagtatttttgttcctcaaagccacttggtcgaatcctgccaaaacctttggctgatgcttggaagcacgaaacaggtcctagtgttaacgcgttttggggtggaactgtagtttgaagcagaaaggggtttctttctgaccaccacccttgaattaggaaaagcagagcaattctttctggtttcataggcctctgctctttagtgtacagtaccattttaaaaattatttatttatgtatctttggccgattacagtgactcacacctgtacctggtactttgggaggccaaggcgggcagatcgcctgaggtcaggagttcaagaccagcctggccaacatggtgaaaccccgtctctaccaagaatacaaaaatttgtcaggcatggttgtgcatgcctgtaatcccagctactcaggaggctgaggcaggagaatcacttgaacccaggaggtggaggttgcagtgagctgagatcacaccactgcactccagcctagacaacagagtgagactctgtctcaaaaaaaaaaaaaaaaagaaagaaaaataaaataattaaatcatctattttaattattttattattttttatttttatttttttgacacggagtctcactcttgtccaagctggagtgcagtggcccgatcaccgcttcctgcagcctccaactccagggctcaggtgatcctcccacctcagcctctcaagtaactgggattacaggcatgtgccaccacacccagctaatttttttaaactttgtagaggcagggtctcataggagtctcactatgtggcccaggctggtctccaactcctggcctcaagcattcctcctgctttggcctcccaaagtactgaggattacaggcatgaaccactgtgcctggcccccattttttttaatagatcaaatgagttgcataggtttacaaacttgatgtcttctatccctgctctatccatcatcctaagaaacaaaatgaagtttttattggcacagacaatatctgttggaagcacattcgtgcaaatccagctatacctagtatgtgacatgtactgtgcaagaatatactttacacgggattgtagcatgccttgaggatgcttgtctggattccattgcatagttgctaaatgctgatgctctgtgagtctgtcattattgcagcattcatggcccaacactcagctgcacaaaagagcttttctgtttctctttccctccctagcacactcctcttgactatcactactatgttttgattgttcaacgtgtaaaacagtccaatttattatttttttaatgtttaaactgttcctttttttttttttttttaaacgacacagggtcttactctgttgcccaggctggagtgcagtggcatgatcatatagctcactgctgtctcaacctcctgggttcaactgatcctcccatctcagcctcccaggtggctgggactacaggcaagagccaccatgtctggctcaaattgtaccagatttaccagtgggactctcctcactttagatggattcttaagtctatgaactaatcccattagtctttttaaatttttatttatttttgtttgagacagagtctcgctctgtcacccaggctggagtgcagtggcacgatctcaactcactgcaacctccacctcccgggttcaagtgattctcctgcctcagcctcccgagtagctgggattataggcgcgtgccaccacgcctggctaatttttgtgtttttagtagagacggggtttcgccatgttggtcaggctggtctccaactcctggcctcaagtgatctgcctgccttggcctcccagagtgctgggattccaggtgtgagccaccgcacctggcccccattagtctttgatcacttccttgcttcctggcaaaatgagattctccagaaccatcatagattttctcccctcacacctggggccaggcatttctccaaggtcttatttttaagaacaagccaatttttatgttctaaattgacttcacacctcctcagggaaacgcagccagtagtttaaaaacatctttgtaacaaatgaacgctaagccccacatcttctctccttatctataaaagagggattacaataccacatgctcatgggaattttctgaggataaaacgagacaataaacataaagctcttagcacagtctgtgggaacaattaagcatgaaagcatgagctgctgctctcattgtcaacatccgattgaaatcttgtttttgagacagggtcttaccgtgttgcttaggctggagtgcagcggcaccgtcagggctcacagcagtcttgacctcccaggctcaagtcatcctcttgcctcagtccccctagtacctgggacgacagacttgcaccaccatgcgcaggtaatttttttttttttttttcagtagagacagatttcgccatgttgcccaggctggtctcgaactcctggactcaagcgatctgcccacctctacctcccaaagtgctgggattacaggtgtgagccatcgtccctggccttattgagatctttagagatactgccaataacttgggttttaaaaattatattgcttgagcccaggaggtggaggctgcagtgagccaagatcacgccactgcactccagcttgggtgatatagtgagactatgtctcaaaaaaagaagaagaagaaaaaattaccattaagataaaaaatgtttatgactgtgtatgacgtttacaaatttagccagcctacgcaacagagcaagaccctgtctcaaaaaaaaaaaaacttagaaatattagtaaacatggtagacgcctgttcattaattctgcttgaacaggtggtcaaggaaaagaaatgacttgaatacagctaagggcttttattcagcagatcctcaccagacggcccctgtgcacagataattgattcactgtggcacagcaggatctgagttttgtaagatgaggagagaggggtacatgtttttgaggactggcccaaatttcacttttctggccaggcgcagtggttctcgctggtaatcccagcactttgaagggccgaggcgggtggatcacttcaggtcaggagttcgagaccaacctgacaacatggcaaaaccccatctctactaaaaatatgaaacctagccaggcgtggtggtgtgctcctgtaatcccagctatttaggaggctgaggcaggagaatcgcttgaaccttggaggcggaggttgcagtaagccgagatcgtgtcactgcactccagcctgcgcaacagagcaagactctgtttcaaaaaaaaaaacaaaaaccaaaaaacaaattacacttttcttcatcttcagctgttgcaaaacctggcatcgtgtccattggagactgtcgttgctgtggtttcaatacctctttcatggtattatgggtgcaatcccttttcagcaactctcagaacagtttattttgcaaggctttgcaatatgtcaaggttcaggggaaagtgggggtaacaaaaagggaggagaggagaaaacggaagagaaaaatataggaaaaggaggcaagagttgaagcaacataaactggggtctctctatgttttattgtagtgcaaacacaaaacattaaatttattatcttaaccattttcaagagtacagttcaggccagctgcggtggctcatgcctgtaatctcagcactttgggaggccacggtgagtggatctcttgagctcaggagatggagatgagcctgtgcaacatgatgaaacctcgtctctacaaaaaaaataccaaaatttaaaaaagggggggagtagagttaagagttcagtagagttaagtctaatcacattgctgtgcatgggtctccaaaactttttcatcttgcaaaactgaaactctgtgcctgatagcagtggggagatccgagttaccctgagttaccagtggcgaatctgtaggggtctgcggcaatttcaatacttgcctccttggaagaaagaatttgactgagggcgtaaggcagaaaaagagaccaaggcaagtttcaaagcaggagtggaagtttattttaaaaagccttagaacaggaggaaaggaaggtactcctggaagagatgcaagtgcatgcctgaaggtcaaagagagcgagagcgagggagtctaaccttgatcctgggagtttacgtgctggcctctttcttacccatgattcttcccttggggtgggctgcccacataagcagtgccctccttacccttggaaagtgagcatgtgcggtgtgtttagggattgtacgaatgccggtctgagactttcttccttttctggtggaggctcccggaaggtcatacttcatacttcaccatttcatctcttttccctggcatttgcagtcaattaacactttaatgttaatagctgtgttactggaaaggagtccagatccagaccccaagagagggtccttggagctcgtgcaggaaggaattctgagtgagttcataaagtgaaagcaagttttttaagaaagaaaaggaatacacgaatggctcttccatagacagagcagccccgaggtctcctggtttcccatttttatggttatttcttgatgatatgctaaacaaggggtggattattcattctttccctttttagaccatacagggagacttcctgacgttcccatggcatttgtaaactgtcacagcgctggtgggagtgtagcagtgaagaccaccagaggtcactcttgtcaccatcttggtttgggtgggatctcgccggtttctgtactgcaacctgttttatcaccgagggctttgtgccgacctcccgtctcatcctgtgactatgaatgcctcacacacctcctgggaatgcagcccagcaggtctcagcctcatgttacccagcccctattcaagatggagtggctctgcctccagtgcctctgatagtgtcacaggccgtgctcactcacatttggctcagaataaatctcttcaaatattttagagttttactctttatcggcatcatcttgtccaattccaatgaggagctcttgaaagctaaaaccaagaagtcttccccatgggagaagcacccccaaatcttgttctcaccaatcaggcgcattcgcggttcttcctttcctccccttctcctcctgcaccacttgctgcttcccttctcccacgaatgctctccaggacctgctgcacttctcacagtgccctaactctcggctctgcaggaaaatgacttcacaggaatttctccttgtaaagattttataacccaatggatggaccctgatgggacaaaacccaggggtgaaaaattaaaatggcaatgttactggagacgggtccctatctagattccaagagagggttcttgtgttgtacccgagcgagttagaaaaacgccacactttgagacgatttaagagtcctttattagccggcgaccgagagacggctaacgctcaaaattctctcggccccgaggaaggggcttgattaacttttagatcttggtttaggaaggggagggcggggggtctagtgaaaaccattttacagaagtaaagtaggcaaaaagttaaaaggataaatggttgcaggaaagtaaacagttccaggtgcaggggctttaagactattatagacgcgaggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtagaggaaaagggagagtctaaaaacaggttagtaaaaaccaggttgggcattacacttggatcttgcggcaagaaagaattcggggcgaatccatagagtaaagtgaaagcaagtttatcaagaaagtagaggaataaaagcatggccactccatagacagagcagcagcatgggctgttggttgccttttttaatggttatttcttgattagatgctaaacaggggttggattattcttgagttttctgggaaaggggtgcgcaattcccagaactgagggttcctccccttttagaccatatagggtaatctcctgacattcccatgacatttgtaaactgtcatggcgctggtgggagtgtctcttagtattctgtgctttataattagcatataatgagctgtgaggacagccagaggtcacatttgtcacctcttggttttggtgggttctggccaggttctttcatgcaagctgttttatcagtaaggtctttatgtcctgtatcttgagctgacctcctatctcatcctgtgacttagaatgccacacctcctgggaatgcagctcagcaggtctcagcctcattttacccaggccctattcaagatggagtggctctcattcgaaagcctctgacagcaagattgaaatagcttcaggagggctcatccagctcatgggctattctgaacctctctttccttccttcattactgtcttctaccccagttcgggtcatgtgacttggtgacttggcctctgtccaagaacactgagatatcttatttgtcattttgtacactggtcagtgatcttgcattcaaatggatttcttctctcagaggggagtccattggggaagtgaagggtcaaaggccagccagaattcataggatagagtcggcagagagcctggaaagcgggaatcttgttgatggctggcagaggccagtataggcattctgccttttaggaggttgcgtagagtcttgtagaagacaatggcagctgtttgggcattctttggcagtgttgtggattttgctgttgctatggtctcaatgcttgccttgaacattgtgtgccttgaacattcatgtgttgaaacttaatccccaagacaatagtattaggagatggtgcttttaggaaacaattaggggtctagactcatcaatgggataagtgtccttataaaagggaccccaggccaggcacagcaggtggctcacacctgtaatcccagcactttgggaggccaaggcagctggatcacctgaggtcaggagttcaagaccagcctggccaacatatagtgaaaccacatctctacaaaaaatacaaaaacaggcatggtagcacacacctgtaatcccagctaattgggaggctgaggcaggagaatcgcttgaatccaggaggcggaggttgcagtgaactgagattgtgccactgcactccagcttaggtgacagacagagcaagactccgcctcaaaatataaaattaaattaaattaaaaataaaataatgaataaaataaaattaaaaaggtgagccattgtgatggatggaaatcacgtaaacctggaccaattcaggcaaagatgttgatgggacatcacgggtaatagccattcctcagagactacctgccaaattgctccccagctgtcttagtcaatttaagctgccataagaaaacaccatagactacacggcttaccccaaccagcatttgtggctcacagttctggaggctgaagtccaaggtcaaggaatggcagattcagtgtcttctgaggacccacttctgttgcctggtccaggctaaactgtaaccataataggttcgttgcatgcagcatgtctgtaccccaactctcagggctgcagaagagaaagaggtttaatcaaaaagaaagaaagaaagaaaatgaaaatgaaagagacacacagaaacattccactggttacagctcagcgtttgccttatttgaacatggttagaacagttggctccctgtgagtggttgaagtatggctgctgggattggtggagatgtcgcttgttacagaagcatactcttaagttaggtgatatggtttggatgtgtgttctcacacaaatctccagtgttgaaggtggggcctggtgggagatgaccggatcatgggggcagcggtttctaatggtttagagttctcacgagatcgggttgtttaaaagtgtgtgacacctccccactctgtctcggtcctgctccaggcatggtaagacacgcttacttcccctttgccttctgccatgactgtaagtttcctgaggcctccccagccatgatctctatacagcccgcggaaccatgagccaattgaacctcctttctttctaaattatccaggctcaggtagttctttacagcagcgcaggaacagactaataccttagcttttcagtccgcccgcctacctgccaagttaggttacggttcacccacaaggactcaagtatgagagtacagagacattctcaggccagattttagtttgatttaatagttcagattcttctgcatccctgtatcttcagaaataaggatgttccctaccatttgatccagcaatcccattactgggtacctactccgaggaaaagaagttattatttgaaaaagataagatacttgcacatgcatgtttatagcagcacaattcacaattgcaaaaatgtggatccagcccaaatgcccatcaatcaatgagtggattaaaaaaactgtgatacatatatatatacacacacacacatatatgtgtatatatatatatacacacatatatgtatatatatatacacacacacccatatatatgtatatatatacacacacacacatatattcattcctttttatggctgagtagtattctatcatctatatatatatatatatatatatatacacacacacatatatgtgtatatgtgtgtgtgtgtgtgtgtgtgtgtgtatatatatatagatgatagaatactactcagccataaaaaggaatgaatgaatggcattcacagcaacctggatggaattggagaccattattctaagtgaagtaactcaggaatggaaaaccaaacattgtgtgttctcactcataagtgagagctaagctatgaggatgcaaaggtgtaagaatgacacaatggactttggggtcttgtggagaagagctggaagggggtgagggatagaagaccacacacattgggttcagtgtatactgttcaggtgatgggtgcaccaaaatctcacaaattgtcactaaagaactgactcatgtaaccaaataccacctgtttcccaaaaacctatggaaacaaaacaatttaaaaattttttaaaaagaaattaaggatgtttctttcctctgggtattaaggcacctttcaaatgagggtggtttgacctgcttcaggagagaaagatgagaggaaggtcagagagaccatcccgcttctgctgttttctccaatgccaaggggccatgttttggggcggcacgtcctgaaacccctcacaagcaacataaatgaacctggattgcttaaacaacaccatccaggcatggtgagtgtgtggggtcattcgaagagtaaggaacgtagaagagctagtgttataaaatggcgaaatcaagaacagcctgtggacagcatgcagcggtggctttatgggattactgttgtgagatgctcagggtgaacgtgggagaatccaagcctgagaccctggctcctccttggcttggatcggggagagcagaacaccttgatctactatcccaccttgtcccctgtagggaagtagaagagccatagccacgtgaggtgatgtccgtaaaagagcgagattgctgtgtgacatacagaacaaagcccaccgccacattctcccttcctgattcttcagcctgatcagaatgtggctttgttcatagactaatggctaaattggcaaaatgccccaagatacggagttgcagttgcgaaagagccacgattgctgtgaagattgtagaagctgtgatctgcaaagcacggagagcaaggcctggctcatgtcaaggactcaataaatgtcacagctgtactcattatttttaccctgaggccacatcctggcacagggagaagggtgattatccattatacgaggtctggctgtggattgggatggcagtgcattagctgtttcttatgtgcatatagagaagtctgctcaggggctgtgtctttgcaagctcatgccctctaagcagctgctttagaacaggtgaaaattggccaggcacagtggctcatgcctgtaatcccagcaatttgagaggccgaggtgggcagattgcttaagtccaggagctcgagactagcatgggcaacacgacaaaacctcctctgtataaaatatacaaaaattagatgggcgtggtggtgcacgcctgtggtcccagctatttgggaggctgaggtgggagtatcactagagcttgggaggcagaggttgcagtgagcaagattgtgccactgtactccagcctgggtgacagagccagaccctgtgtcaaaaaaaaaaaaaaaaaaaaaaaaaaaaaaaaaaaaaaaaaaaagccaagtgtgtggctcatgcctgtaatcccagcactttgcagggctgaggtgggcaaatcacctgaggtcaggagtttgagaccagcctggccaacatggtgaaaccccgtctctaccaaaaatacacacagaatattggccaggcatggtggcgcatgcctgtaatcccagctgctcgggaggctgagtgaggcaggagaattgcttgaacccgggaggtggaggttgcagtgagctgagatcaccccactccactccagcctgggcaacagagcgagactctgtctcaaaataaataaataaatagaacaagtggaaataaatgagacgtcccccatcccaaatgttttcgtcccaaatgaaaatgagcagaggccacttattcagagctagccctagtaagggagtcagacatcaccctttgcattttggcagggaccgaaagacaagtagaggaggctttatagtgtcagacctcaggatacacgtccccaaacatgactgctggcaaccagaatataccagcccaacatacccattactttgagctgaaacactgagaaccagctaatacaagaggagctctttacttgctcctcgacagctaaaaataaagtacaaatttcccctttgaaaagagaaatttaggccagacatggtggctcacgcctgtaatcccagcacttttggggactgaggcaggttgatcacctgaggtcaggagttcgagaccagcctggccaacatggtgaaaccccgtctctactaaaaatacaaaaattagctgggtgtggtggctcatgcctgtaaccccagctactcaggaggctgaggcaggagaattgcttgaacccacgaggtggaagttgcagggagccgagatcatgccactgtactccagcctgggcgacaagagtgaacaaaactccatctcaaaaaaaaaaaaaaaaagaaatttttgttttgttttgttttgtttgtttgagatggagccttgctctgtcgccaggctggagtgccgtggtccgatcttggctccctgcaacctccccctcccgggttcaagcgattctcctgcctcagcctcccgagtagcacaagcacgtgccaccacgctcagctaatttttgtatttttagtagagacggggtttcaccatgttggccaggctggtctctatctcttgacctcgtgatctgcctgcctcagcctgccaaagtgctgggattacaggcatgagtcaccccacacccagccgaaatttggtaaactcaatcaagtttatttatttatttatttatttttttaatgggtcgcgcttttggtgtcttattttcctaacccaaaacgaaaaagactttctcctctgttttcttctgcacatgttatagagatcgcacttacatttgggtctctgatccactttgagttaattttggtgcagggttttccattcacggaacatgaagttggatttctaataggtcaatatatgaaaaatttcccgcaaagtttttcttttcttttcttttttttttttttttttgagactgtcacccaggctggagtacagtggtgcaatcacagctcactgcagccttgacgtcccaggctctagagatcctcccacctcagccttccaagtagctgagaccacaggtgtgcaccaccacgcttgcctgattttatattttttgtacagacggggtcccactgtgttggccaggctcgtctcgcactcctgggcttgagtgatccttccacctcggtgtcccaaagtgctgggatgataagcatgagccactgcactcggccagtttctagtttggatatttgagtggacttcccagcccccacacagcatgctcatttcgtgtaagattgtgagagagtgcgaggagagaaagagcatgcagccagcgttggagcttcggagacatcccgggcaggagcttcccagggtctcatttgttctgtctcatggttggcacacgaaggacagtgagaggaatcttggtttcagggggcctcaaaccagacatttgaggaggtaggggaggcggttgccactccgctcattcagtgcatccaggctgtctaactggttaggccacttgcaaatgtgcaaaccttaagtaaagaaacagactctggggtcaggggggaggtttgaactgtaactagcgcgtcataaatcccagcccttatcttgaacaagagtcaaagaccggacttgaaggcatcccccaagataaaggtaggccctctgcagggcagctgtaagtcagctctcctccacccctctggctggccccctccttatccgagtcctgcttccttcctctttaaatctgcagacaatgctgcttctctgcaggtctctgcatattccctcagctcacagaccggctgcatacttggtattttcagggttaggtttgcaacacatgactggggaaatgcatgaaaaggaaatgatgcaagaattcaccgcggacacctttaggtgagaaggagatgtgacaaaaagtctctgcctggccaaaccgtagccaggctcctgaagcccctcccaggcccggtggtgcgtttccttatagaattagatttcagcaaagtaccggctaagtcagtttggcgagaagccaccattcttgatatcatgttcctcgtcgtccaccacccctggttgatgtttaacccccttggctggctttaacaagccaggttggtttagccaggacccgcttcacctctgatgtttccttttagtgctttgccatctgtacacccgctgcctgcccccgtggctgtacattcccacttgcccttgctgtgttcatattggaagctgagcccagcctctcctgcactgtgaaccgccattgcagtggtccctgtacttcacacgataagcctggataatgtcttcgttatctttttggtgatgctttcccaagtacgaggttcgtgcaaaagtaataactgcaattaccaacctagtatcactgaatagttttttctttaacaaaggttttgctcccggacgaatgaacgagtgctggctgcttgttcttggggctcaacaatgaggtgcagacagactggggagaaggggatttatttctccaacgggttacagggagaaggtcagattaactcaccaggtcagctcaaagtgacaagttttttccagggtttctatgcattttaagctctatgcccacgtgtaggattgcacctacgagcgggagtatttcattcggttcctgtctaatctttaactagggtctggggtctgggaagttttctctagacgcttaatcttcagtgagccctggtatgacgtgtttaacttgtgcatcatcagaattataataaagcgttagtggaaaaactggttgctccggctgctaatggaagcctggcctgccacagtttgactcaaagggaacctaactctcaaggagccataatcccagcactttgggaggccaaagtggaggattgcttgtgcccaggtgttggagaccagcctgggcgacataggagaccccatctctatacataaaagaaaaattagtcgggcatggtggcttgcgtctcttgcctcagctactctggaggttaaggctggaggatcgcttaagcctgggagttggaggctgcagtgagctgtgattgtaccacagcaccccagcctgggcaacagagcggaaccctgtctccaaaaacaaaacaaaacaaaataaaaaacaaaagcaaagagccatacaagaaagttttaaagaatgtattttttaaaagccccagtgaggttttctgcagaaatcctgggtgcttctaagccagccagaacctctacctttaaagcatgtctgctcatgtcataggtcttacaggtatggaggaaagttgaggtttttaaatttaaaaaaatataaaaaagaagatgaacacttctgaatcttcttttttttccttttgagcatgttctctgggtggggaatgtgctatggtttctgaaaacaaagaagaaaacatgtcatccttctgttccaggttctcacgatggtctaagggaatgtgatttttttttttttttttttttaatggatagcatgatagtggcatggggtgacgtggaggccaaggacagagggtgaggtattcagcctggagatgacctttaacctcaaggctttcttccttttaaaatgtttgcagattgtttgttttttgtttttgtttttgtgtttttttgagacacagtcttgctcttgtcgcccaggctggagtggcatgatctcggctcactgcaacctccgcctcctggttcaagtgattctcctgcctctgcctcccaagtagctgggactacaggtgtgcaccaccacacccagctaatttttgtatttttagtagagacagggtttcaccatgttagccaggctggtcttgaactcctggcctcaagtaatccacccgctctggcctcccaaagtgctgggattactggcgtgagacactgtgcccagtcaaacatttgcttttttgacaataatttattgggtttttttttttttttttttttttttttttgaggtagagtcttgctctgtcacccaggctggagtgcaatggtgccatctcagcttactgcaaccttcacctcccaggttcaagcaattctcccacttcagccttctgagtagctgggattataggcgcccgccaccatgctcggctaatttttgtattttcagtagagacggggtttcaccatgttggccactgtggaactcctggcctcaggtgatccgcccaccttggtctcccaaaatgctgggattacaggcataagccactgtgcctggccaattgtatatttcaaaataactagaagagtatatttagaaatgttcccaacacaaataaatgataaatatttgaggtaacggatagcccagttacccagattggatgcctacacattgtatgcttgtatcaaaaatatcacaccaatcccatagatctgtgcagttctgatatattcataaaagttaaaagttttaaaaattgcctggcacagtggctcaaacctgtaatcctagcactttaggaggccaaatgcgaggactgcttgaagccaggagtttgagaccagctagggcagcatagtgagaccccatctctatgaaaaatacaaaaattagctgggtgtgttggtgtgcgcttgtggtcccaagggagcttgggaggctgaggtgggaggattgcttgagcccaggaatttgagaacagcctgggcaacatagcaaaacccagtctctacacaaattttagaaaattagctggaagtggtgacacatgcctgtggtcccacctagttgggaggctgaggtgggaggattgcttgagcccaggtagttgagactgcaatgagctgtgatggtgccactgcactttagcctgggcaacagagcaagaccctgtctcaaaacaaaacaaaagaaacaaacaaaaaaccctcagaaccaactgttcagataacaaaaaatgactttatgattacattaggcccacccaaataatccagaatcacctccccatattaagacacttaatttcatgaaatctgagaagtctgttttgccatgcagtgtgatatggtttggccgtgtccccatccaaatctatcttgaattcctaagtgttgtgggagggacccggtgggaggtaattaaatcatggaggcaggtctttctcatgctgttctcgtgacagtgaataagtctcacgtctttctcatgctgttctcgtgatagtgaataagtctttcgtgatatgctgatctcgtgatagtgaataagtctttctcatgctgttctcgtgacagtgaataagtctcacgagatctgatgattttgcgcaagctcttttctctttgcctgccaccatccttgtaagatatgacttgcccccccttgccttccaccatgattgaggcttccccagccatgtggaactgtaagtccattaaacttctttcttttgtatattgcccaggcttgggtatgtctttatcagcagtgtgaaaatagactaatatacaaggtgacattatacaaggtggttaagggttgactggtgtttcttcccccacaattcatatgtggaagatctatcccctctccatctgtgaatgtgaccttatttggaaatgcagtgtttacagatgtcattagtttagatgaggtcatcctgcaggaggataggctgtaatcccatgactggtgtctttatgaaaagaggaaatttggacacagacacacacagaggagaacaccatgaaaccatggggcagagactggagtgatacaaccaaaaacccaggagcacctggagttgccaaggtctggaagaggcaggaaggatcctcccctatagcctcctgagggagtacagccctgagacaccttgatctcagcctcctggactccaggactgggtaaggataagtatctgttgtttaagcccctggtttgtggtaacttgttatagcagccacagaaaactaattcagacatattcatagactccagggattctgatgtctgtatcttgaacagcatgagggatcattattaagccattggcagggctcggttctaattgtggccatggattgcctttggtctgttggacacgtccttttctctggaacagccatggcaactccatgtgattagattaggatgggattctagggtggagatcccattccaaccatgggtggacatttaatccaggaacggccaagtccttcagccataatgattggtaccaagatgggtgatatcgtttggctgtgtctccacccaaatctcatcttgaattgtagttccataatgtcctaaacattagaaacggtaaatgttagctaacatggcaaaagggactttgcggctataatgagttaagaatcctgagatgagatgatcctggattatcctgatgggttctaagtaatcacaagagtccttataagagggaggtaggagtgtcaaagtcagagaaggagatgtgaagagggaagcagaggtcagagagagagagagagagactggaggatactgtgctgctggctttgaagatggaggaagaagccataagccaaggaataccacagcctctagaagagggaaatctcaaggaaatggattttcttttggaacctccagaaggaaccagcctgctgacaccttgatttttcgacttctgattaccagaactataagaaaaattgtgttattttaagcaattaagtttgtgacattttgttacagcaccaatagcaaactcatacactcctttaatggtcttttaacctcaggtcctctctctctctctttcttctcctcctctttcccttctccttcttctttttctctcaatctctctctctctcattctctttctctccatctgttctctccagaagggcagatgaactttttatttacatgggggctcttgagtccataagagagaagtcagaagctgccaggtctcctaagtctagggcaggaaggatagtatcagcatcacttctgcggcattctgttggtctatgcaaatcagaggctcatcctagatccaaggggaggaaaaaggctccaacttgtagctgggctcatttggaaggtaatgggaggacttggcagctgtaagacatgtaccacatctagacttcaacctacagaaaagtccaaagatacaccaacagcagcccaagttagtcaactgaagctggctcaaggctgccccctttaggtggagactaaccagctccctgacatccttcagttaactgcaccttcctcctttttgctgcctggaatgtctacatgctgcctggagctatggcagccatcttgtgaccatgaggcaaaccctatgtgcaagagcaggaagctggaaagaacctgtcagccctggattgcttcctctgtgacccccattacctgggagagaacacatctttctcttgtttaaggcgttcttattcccagtcgccctctctcccctgtataaccctaaaagcacaggagtacacttgtgactgtgacttaagtttttcagaacgggggagtttggattgtttagtcctctctccatgaatagtgaatagcaatgccaggtgagttccttcaaagctggggggtgaaggggtggaggtggaaaagtaggattgaggatgggaaataaaaacaaacaaatgacaccatccagggagatttgtcacattttattcagtatttctgctgcactgccagcctagggatgcacttgattcccaagaaatgcaactgtcctattcgcagagccgtccacaggtacctaccccctggactgcagcaactttattaccttaactagcacagaacagaggttgatttaaactccttacactcacttctcagatcaatgaatgggcaaagaaacacctcatggctctgggaaggcatgctgagacccgtttttgcaagtcctgaggaatggaagaatatagctgccaggtatcccaagtctagggcagggagggtagtatcggcatcactttcactgcattctgttggtcaacgcaagtcagaggctcagcccagatccaagggcagggaagaggctccatcgtgtagttgggctcacttggaaggtaatgggaggagttggtggctgctttaagacacataccacatctagatttcaacctccagaaaagtccaaagatgcactcacaggagcccgttagtcaactgaagctggttcatggctctcttcttcaggtggagactaaccaactccctgacctccttcggttaagtgctccttcctttttcctgctgcctggaatgtctatgtgccatctggagctatggcagccttcttgcaaccatgaggcaaactctatgtgcaagagcaggtagctagaaagagcctgccagccctgggcttatatcctgcttcccagggagcttaaagatagcaaaacccacagccattttcatcaaatgccaggaaattcttaggctgggattgttgggattgtttgaatggttgagcgtgaaagacttgttataatgggcttgttgaatacggtgaaagatgagatggcttttagctgcctccactccccgtgtcccatgctccatagatgtttctttttttttttttttttaatcattttttggttatgccaggtgtctcctgtgtgtccctccagatccctctccagccctagaaacctgagctctataaatgttgcctctctccactcatcttctctttggcttcaggttgagttcagccaacagatgcccctgtaggatttggacacagggagccaggggagaggggcatcagctgcctggttagcagggctgtgatgattcttctacctatgactctcagtgctgttgcctcttcctctggatcttggaagcttccatgctgaggtctgaaggtggctccctgcctcccactgatgtccttagaatcccatcctcacctaatacctggtattgaacactgcctttcttagatgtcatttaggctctcgtttcaattcccagtatgcttcctgcaaagacctcgatagatggactgaggggaatagtgcaaggtcctcccatccccagtattgggatctaggggcagggggtcccagctgtgcagtaggttaggactacacttccatcatcaaagccacagagggaagaggtgaggatgaaacacactagaattgacttagaaaacacactggccaaatcttagctatttgaggaatgtagggagaaaagccaccttctctctctatgtctgaaggttcccatggctgtctctttgcccaaggggcaaactttccatcagggcatcttctgtgcctctgaggatcattttccaattataggcaatggtagtacgtgtttcagtgcagaatgagatagagttgtttaatttgacaataaagcgatgcgtcaaaaacctcagtcaacacagtaagtgttttcttgttttcctgctgaccaacctaattctggtttcatacagggcagccaggtgcccacctaaaagactgcacttctcaacttccagttgtttctatggataatggttggaagcagaaattgggttggggcttccagataatcccccctcacagggactgcttcaagagaaagggatgccctttggttctttctcctttccactgcctggaatgtgatgtctgacactgtggcagccatactggcataatgaggccaactctctgccatgctaagagtggcagagctgggaattgaaaagagcctgctagccttgggttgcttccccttgatcggctcattacttggaagagaacacacccttctcttattattttctttaaggcatttttttttttttttttttaaggcagggtcttactctgtctcccagcccggagtgcagtagtgcaatcttagctcattgcagttttgacctcccaggctcaaataatcctcccgcctcagcctcctaagtagctgagactacagctgtgcgccacgacatctagctaattatttgttttttgtagagatgaggtctcactgtgttgctcaggctgggtaggtgtctaactcctaggctcaagtgatcctcccaccttagcctcccaaagtgctgggattacaggtgtgagtcaccgtgcctggctttgtttaaggcattctttttccgcagcatctgttaccagcagcctgaagccatttctataacaatatcaggaagacacatggacagagaccctaatgtatgaaaaatgcatcaattatttgagattaatgagtcctcataaacagagactgagaggctctaactttcctccgctatgtgagagtaggaacagacactcctccctgtccttttgtaaggctgttatgtcatctaggtgatgaaattgcaacaatgctttaagacggaggggtgaaaacatcgggcattggcacaatgacgaaccctgagatttagaagaggaagaggaggcatcagtgggtgcctactgggacagtcttatttcacaaatcaggaaagggaaaccctacatgggcgcagtggctcgtgcctgtaatcccagcactttgggaggctgaggcaggtggatgacttgaggtcaggagtgcgagaccagcctgggcaacatggtgaaaccctgtctctactaaaactacaaaaattagctaggcatggtggcaggtgcctggtgcctgtaatcctgggtactcaggaggctgaggcaggaaaatcgcttgaacccgggaggcggaggttgcagtgagcagagatcgtgccattgcattccagcctgagggacagagcgacactctgtctcaaaaaagaaagaaagaaagaaagaaagtggggacccactctcagtccagggcatgttccttgcaaaaagggaagctgaagatagaaccaagcttggagaattttgtttgcaacgcagtcaggctctcctggatcctctctcacagtcctggcattcagggggtgccatccccatcctcgtggcatgaacagaacgggaaatgtccgcagcacggctgcagccacggcttccacaggatgttgctcatggaaaactgctggggcacaggactcagggtctgccgatgctccgacaccgcggcacctacccttgctatcacggcgtggtacaggggctcggagtcgggggtcaggggccgtgcctcggaggggtccctggagaggtcaaagagcaaagggggtctgtgatgggtcacgccctccccggagcatgggcagacgcctcggccgtagcaggcccccgctccctcggggtggaactgcggggtcgtgtaatgaaccttccagacgcttccacctggatgcagacaagaagggagtcagggtggcagaaatccacgcaggtgtgaacgcagaacgcaggtgtcggccctgtggtatcagcatgaacctccctattcagtgaaaaggaggagggacacgaggcagtccacacaatcacagccttcagcttgcaaagtcagagcatgtgtgtgtgcgcgcgtgcgcccatgtgtgtccgtttgtgtctctgcattgcatgccccaggcaaagggactcattgcagagcgctcactgtggctgctttcagaaatcagaatcatagaggttccttaattcttcccctttcccctgtgttgaaactgttcagcgtcgatctactacctttctacacagaaacaaccatgatattttaaacagcatgattgggtacttatctatctatcgctacctatttatctatttatctatcaatccatccatttatcttacccatcgatctcatctatctaccattatctatttatctatcgatcatctatctacctacctatcatctatctctgtttatctacctttcatccatctatctgtccatccatctattcatccatccatgaactgattctactttttatctatctatctatctatcatctatcttatctatccatcatctatcttatatatctatcatctatcttatctatccatcaatcatgtatcttatctatcatctatcctacatatctatatatttatccatccatcatgtatcttaaatatctatccatcatctatccattatctatcatctatccatccatcatctatcttatctatccattatctatcttatctatccatcatccatctcatctatctatctatccatcatctatccattatgtctctatcatctctctctctctctctctcccccccccatcatctatctataatctactcatcggtttatctatctctatttctatagctatctgtccatccacccatccatccatccatccattcatccatccatccatccatccatccacatatccacacatcctattggctgtttctctggacaaccctggctgtgggcagcaggtactcactgtccttctggtgccagcgtgctgcgtgaagatgctgcccacagtaatgaaacaggaactcatgtgccgagcgtgcctcagctccctgcagcaagggtaccaggctgtggccatcaatcaccctgatttcatgaagagaacacagagcagagtcagaccacgggttcccaggcagccttttgcacctgggaacacatctcccagaatgcaaggctccccagcaaatggagcagagatgagctgtctctccagtcgctgttcagattacaggttgctgagcaggatacatgtggttatttcaagacacagtgtctctaagtgttggggtcatttgttatgcagcactgcataagcagagtgcacacacacacacacacacacaccccaacacacagcactgtcaccttggaggtcaacacaaagccttcaaattccagctggacagcccacattcctaggttggcttttcttacttttttttttttatgaggcagagtcttgctctgtcacccaggctgcagtgcagtggcacaatctcagctcattgcaacctctgcctcctggtcaagtgattctcatgcctcagccccctgagtagctgggactacaggcacaagccaccacactcggccaatttttgtattttttgtagagatggggtttcaccacgttggccaggctggtctcgaattcctgacctaaggggatccgcccatctagcctcccaaagtgctaggattatcggcatgagccattgcatccgacctgtccttactttttaatcataacagaccccaagacacatggccacatgggtaaaggagatggtggcgcatgcctgtaatcccagctactcgggaggctgagacaggagaattgcttgaacccaggaggcggaggctgcagtgagccgagatcatgccattgcactccagcctgggcaagagtgtgagactctgtctcaaaaaaaaaaaaaaaaaaaagcttatttatgtaaccaaataccacctgttccccaaaatcctattgaaataaaaaaaaaaaactaaaaacaattaaaaaaaatcagggaacaggcagccttatctccacgtacctgtcctggggcacctcgccacccaccagctggaccacagtagggaacacgtccatcaggctcgtgggctctccaatcactcggccggccgggagcacccccggccagtggaagatcccgggcacgcggatcccaccttcccatcctcccatgcccttcccacctgtaagtagaagacatcgttaggattttgccggaaactgcccagtctgtacacacatctggatgtatttgtgcataggtatgtgaatacgcacagccacccggatgcacacatgcacactggggcagcctcagcttcccaaaaacagccacagcaatatttccagaatcatgctactccctggcctcttgaatatcggtgggtcgctgtggctgattcaactgttctagtcgatctatgctacctttatttagaataaaataatgtattaaaatattcattaaatttaataatttaaaaatgtttgttaactatcaataatttttaaaatatgtattattatgcatcaatattaattgatgcatttaaaatattaaaatagtaataaatttattaaatatttaaaaattaagactataataaaataaattttaattttatctgaattatttatttatacctctctgtattctactaaaatgtaaaccctttaaaggaaggggatgtgactttttatctgcctgtcctgctcatctaggtagaacttgtactacagtaggtgctcaatgcattctttttgaaatgagcaaactcattttcagttcaacttgttctgggaccctcagtggtggcagatatttggtcgaatgcatatgtgtccccgatgtccacaactcacctttgtaaattccgttccatccccctaactggctgtgtccatctcttgcctctaaatgtcctccatggtcagaggtgaaatacgtgaatgttgagttctttaaaccattgtcttcgatggcattaagaaccttacctttacagaaaatggaaagtttcaggaccaagaaaacaaagcagcatccactagttcaatgcgcttcttcctttctgcaggagacacctcttgccaggaagtcataagaagagaccacacttactcggaggccgtggttacaatgtgatcccaaagtgtaagacatagctaatcactgtgataccacaggactgtttacaatgcaaaccaacaataaaattcgaagccccccaaccgactgatggactctcccttcagccaaggccattccaaagttaacctgaaaaactaggtcaggccgggcctggcggctcacacctgtaatctcagcactttgggagcctgaggtgggtggatcacctgaggccaggagttcaagaccagcctggccattatggtgaaacctcatctctaccaaaaacacaaaaattaggcaggtgtggggggtgcacgcctgtaatcccagctacttgggaggctgaggcaggagaatcgcttgaacccaggaggcagaggttgcagtgaggtgagattacactactgcactccagcgagggtgacagagtgagactgtttcaaaaaaaacccaaaagagggccaggtgtggtggctcacgcctgtaatcccagcactttcggaggctgaggcgggtggattacgaggtcaggagattgagaccatcctggctaacaccgtgaagccccgtctctactaaaaacacaaaaaattagccaggcatggtggcgggagactgtagtcccagctacttgggaggctgaggcaggagaatggtgtgaacccaggaggcggagcttgcagtgagccgagatcgcaccactgcactccagcctgggcgacagggtgagactccatctcaaaaaaaaaaaaaaaagaaaaaaaaaaccaaaagaaacaaaaaacaaaaacaaggtcaggccatgttggaaagtagtgggggcggggggagtggtggacatgcgtcatgataccctcctccctttggaattcaggcacaactgaccagcattcacattgaaacagagacctatgactgagagaaggccaggcacagtggctcatgcctgtcatcccagcactttgggaggccgaggcaggaagatccattgagctcaggagttcaagaccagcctgggcaacatggtgaaaccctgtctctacaaaaaatacaaaaattagccaggtatggtggcacatgcttgtatgtagtcctagctactcgggaggccgaagtgggaggattgcctgagcctgggaggtcaaggctgcaatgagtcaagatcacaccatgcactccagcctgggcaacagagtgagaccctgtttaaaaaagaaaaaaaagactgatagaacagactctttaagtctgataagaaacatttaccatgtattctctctgaagcctgctacctggaggcttctttggcattatgaaaccttggcctccacaaccccttatcataacccagacattcccttctattgattctcagataataactcaaccacctgccaatcagaaaatctgtgaatccgcctttgacctggaagcccccctttcagtggtcttgcctttctgcactgaaccaaggtacgtcttacacgtgctgattgatgccgtatgtctccctaaatgtataaagctgagctgcatgccgaccaccttgagtacatgttctcaggacctcctgagggctgtgtcacaggccacttgtcactcatatttggctcagaataaatctctccaaatattttacggagtttgactctttcggtcgaccccaagataccaccaatacaaaacacagaatgaacacacaacgccaagaggttgccagtgagcacgcttttttaaacatagtgccgtgtgtgtgtgtcacataataaagacactggggagagggaaatggtgagactcagtgatgacagaaccctatgtaggaggaagcagggctgtaactagcatctatgggcattggcgtattggaggctgatggctcagcagcgcagaggacgccctgcaaaccaagcagttgctttatccctggaggccactggtcattgaaagcactgaaagtcaaaatgatataaaccacaaggtcatctgtagctctgaaaatgcagactttgaagcctgctgtaaactgaaaagtatctgaggcgggtctcaatccatttagaaagtttattttgccaaggttaagaatgacacagcctcaggaggccctgatgacatgtgcccaccgtggctggggcaaagcttggttttgtatactttagggagacatgagacatccatcgctacatgtaagatgtacattggttgagctggaaaggtggaacaactggaagtggggaatttaaacatattctcattggtaactgattgaaagagttatcaatagaaaggaatgtctgggttatgataaggagttgtggagaccaagcttttatcatgcagatgaagcctctaggtggcaggcttcagagaaaatagattgtaaatgtttcttatcagagttaaggtctgtgtggatgttcatgctgcggggggtagaatgaggcaagcccaaccccctcttcccgttatggcatgaaccagtctctcaggttaaattttagggtgccctggcaaaggagggaatccattcagatggttgtggggggccttcgaatttatttttggtttacactgtgaaccaatcccgccctatcactatgcttgtctcgggagatatgttcagattctgcaaggattttaatatctacactctcttaagaatctgcagcctcgttggtcctctccagggtttcttcaaggccatagaaggaaggtgacctctctgcattgtccgaactttattgctttagtttctgtaacttctaatgaggctgttaagtcattggctgtgtagaaggttgacaatatagtttggatgtgtgtccccgcccaaatctcatgtggaattgtcatcctcagaatcggcggtggggcctggggggaggtgactgaatgatggggacagagttctcatgaatggttgagcaccatcccccgcttggtgctgcggagggagtagcttctcacgagatctggttgtttaaaagtgtgcggctcttcctctcctctcttggtccttctcctgccacaagacgcctgctcccccttcgccttccaccatgagcaaaagctccccgaggtctccccagaagcagatgctgccatgcttcctgtgcagcctgcagaaccgtgagccaatccaacctcttttctttataaattacccagtctcaggtatttctttgcaagaatggactaatacagttgattttgtgcaaaattagactaagtaatcagaaatactgaaggaccaaataaatgatatgagagaagtttttctccctattcttcgtcttttatttctttttttttttggagacagggtcttgctatgtggcccaggctggagttcagtggtgcaataattatagctcattgcagcctcagcctcctgggctcaaatgatcttcccacctcagcctctggagtagctgggaccacaggtgcacaccaccatggctaattttttaaattttttgtagagatggggggggggggcgtctcactatgttgcccaggctggtcttgaactcctggtctcaagccatctccctgccttagcctcccaaaatgctgggattaaaggcatgagccaccttgccccacctgaaaatgcagacttttaagactgtgaactctatcacgatgcttgtctcaggagacacattcagattctgcaagaattttaatgtctatgctcttttaagaatctgcagcctcactggtcctctccagggtttcttgaaggccatagaaggaagacagcgtgtctgcattgtcctgaacattaactttatcgcttcactttcggtaacttctgatgatgacatgaagtcactggctgtgtagaaggttgattttgtgcagaattagaccaagtaattgggaatactgaagaagcaaataaatgatatgggagtgtgttctgcccccattctttgtactattattattattaaagagacagggtctcactctgttgcccagcctggagtacagcagtgcaatctcagttcactgcagccttgacttcccaggctcaagcgatcctcctgcctcagcctcccgagtacctgggactacaggcgtgtaccattatgcctggctaagcatttatttttgtagagatggggtctcactatgttgtgcaagctggttttgaattcctgacctcaagtgatctgtccatctgggcctcccaaagtgctaagagtaactcttattctttttctttttttttgagacggagtcttgatctttcacccaggctggagcacagtggtgcgatctcaactcactgcaacctctgcctcccgtgttaaagcgattcttgtaccttaacctcccgagtagctgggactacaggtgtgcaccaccacaccgggttagtttttgtatttttagtagagacagggtttcaccatgttgcccaggctggtctcaaactcctgacctcaggtgatccgcccgccttggcctcccaaagtgctgggattacaggcgtgagccaccgcccttattctttattgcaagttggttcatattcagatggccagtctgttacgccctatgttcaaacctgaggccgagggtggagtgaggctccatggtaccttgacttacctatgagccagtccatctcctccacattatcaccatataagccatgctgacttttccccaggaatgcactcgtggtcacaaggggaatgtgcacatgcagcaaagaaaggaagaggagaaatggcccatgcttgtgtctgaaagaagaaaacttccttgagaatacacagaatatacagtacaccaaagggacccctgcacccatacgttcactccagcactattcacaagagccaaggcaggggatcaccttctgagttcatcagtgggtgaacacagaaagaataaatggtgggccaggcgtggtggctcatgcttgtaatcccaacactttgggaggctgaggcgggaggatcacttgaggccaggagttcaaggccagcctgggcaacacggtgaaatgccatctctaccaaaaatagaaaaattagctgggcgtggtggcttgagtctgtggtcccagctacttgggaggccgaggtgggaggacggcttgagcccgggaggtggagcttgcagtcagccatgatcataccactgcactccagcatgggtgacagagccagaccctgtctcaaaaaaaaaaaaaaaaaaaaagaatatattgtatatgtccacaatggaatactattcagccataaaaaagaatggaggctgggcacagtggctcaagcctgtaatcccagcacttcgggaggctgagcctggcagctcagttgaggtcaggatttcaagaccagcctggccaacatggtgaaatggtgaaaccccatctctactaaaaataaaaaaattaacagggtggggtggcaggtgcctgtaatctcggccactcaagaggctgaggcacgagaattgcctgagccttggagacagaggttgcagtgagccatgatcacaccactgctctccagcatgggtgacagagccaacgctgtctcagaaaaaaaggttatatctggtatatgtacgtgatggaatactattcagccatcaaaaagaatgaaatcctgtcatttgcagcaatacagatgaaacaggaggtcactatgttaactaaaataagccaggcacagaatgaccaatactgcatgttgtcactcatatgggagagctaaaaaaaaatcgatcacatgaagatagagaatagaatgatagagaccagaggctgggaagggtgaaggacaaagagaagtggtttaaagagtacaaacatacagtaagcttaaaggagtacattcaacgtctgatagcagagtagggtgaccaaagctaacaaaatgtattgtactcaggagatggacactgtaagtatgctgtttgatcgttattcagtgtatacatgtaacaaaatttcacacataccccatacatttgtacaaattaaaaagtaagggccaggcacggtggctcacgcttataatcccagcactttggaaggcagaggtgggaggatggcttgagcccaggaattcaagaccagcttgggccatatagtgagacattgtctcaaaaaaaaaaaaaaaaaaaaatgagacattagaaaaaggccaggcacagtggctcacttctgtaatcttagccctttgggaggccaagatgggaggattgtttgagcccaggagtttgagaccagcctgggcaacatagtgagaccccatctctacaaagaatgcaaaaaaaaaagtttaaaaaactgtcaataaaaatgtacagaatccaatggcgtgtatgtcaatgctattcgagccatcacatgacatccacttcgagactctcatatgggaaacccagccacatgaaaaggttggcttctgcaaagccgtctcctccgagggttggtgtctgagatcccaaagattataaggggactctcagatgctctgagcagttaccgtgtcttttttttaaattaaactttatttttatttttttagcgacagagtctcactctgtcacccaggctgaagtacagtggtgtgatcattgcttactgcagcctcgacatccgaggctgaagcgaacctcccaccttagcctcctgagtagctggcattgcaggcacacaccactatgcccggctaatgattttatttattgtagaacctgtcttcctatgttgcccaagctagtctaaagcacctgggctaaaagatcctcccatcttggcctcccgaagtgctaggatgacaggcatgagccatcgcgtccggccccatctcctctttaagatgcgatggttgcttacctttcaatataggaaacagcttcctttagcataagactcgctgttttctccagaaccatgggttgctccgtgacgtcatggtttctcatcaggatacagttccagcgtcgcacaaacccgaaggaggagtaccaagagatgaaaaacaggcagcccacgccggccatgccggtgactgctctcgcggagacagagaagaaaccgcaggtctggccggcagccagggtgagaatccccagcgccaggaactgggtgtaaccccagagctgcgccctcagggcggcgtccacttcggggggcctgcctgggtcacagtcgtttgtgagcgtgaagggcatgccgtagaaatagtcaaatccgtggttcagggggtggtggcagtgatccccgcgggatgcacaattcacaccctggtgccattttcctaaaagaaacgcaaatgttcaacagagacccgctttgaagcagccctgtctgctgcaaagaacctcggaatcattccgcgtcggcaggaaaagaaaagtctgcaaagagcaaaactggaaatggaaaggcaatgaatggattggatacctgtgtttaaatgaacgcattctgatccgtgaagactaacgaatgcatccatgtcagaacccttggcaagtgattaaaggtttaagactttcggccgggcgcggtggctcacgcctgtaatcccagccctttgggaggccgaggcgggcggatcacgaggtcaggaaatcgagaccatcctggctaacacggtgaaaccccgtccctactaaaaaaatacaatacaggtggcgggcgcctgtagtcccagctactcgggaggctgaggcaggagaatggcgtgaacctgggaggcggagcttacagtgagccgagatcatgccactgcactccagcctgggcgacagagccagactccgtctcaaaaaacaaaaatgaaaataaaagtaaaaattaaaaaaagtgagagagaaagaaagaataaatccaccctcagagtaggagacacacagacttctacagtataaagcactggccctgtaatcccagcactctgggaggccaaggtaggtggatcacttgaggtcaggagttcgagaccagcctggccaacatgctgaaaccctggctctactaaaaatgcaaaaaaaattagccaggcatggtggcacatgtctgtggtcccagctactcaggaggctgaagcaggagaatcgcttgaacccaggaggtggaggctgcagtgagttgcaatcgtgccactgcactccagtgtaggggacagagcaacactccatctcaaaaaaataaaaataaataataaataaaagaagaaaaaactttaaaaaaattcaaaataaaaataaagtggcaggaaacttgaaaaggaggaacaatggttgtcctttagaaaaccacagcttcggacaagttagggtgttgcggctcctgtgaatgggacagtggctttgagtgtgagaaaagcacagaggggaactggggaccctgcacagagatcccaccaccaggtcggggcgggtggcctcaccactgcgctcccacgttctcatgtgtatgacggggacagcacctctaaacacacaggctgggtaaggaatgaaggaggtaaccagcagactgcctggtgcttggcggcataaaccaacatctccctcctttcctctccgtgcagaaaggagtttaaggggcaggcctgagctagtgccccttacaaaggctggcttgtaagattccccgtggctggtgtttgagatctggatttccaatggagaagtcacaccattaaaataataagctgactgtgcctaaactatatgcaaaagcaacgtggttcatgctaaacacctcctttggttctgggagtctggaattcgggtgggtgccaggcagtgagtgcctgcaggaccagcccccaacagaaacccctgggcactgattctcccgggagcttccctaatagacagcattccttgcgtgttgttgaaactcatttctggaggaatatggtgcatcctgtgtgatcccactgggggaggattcttgggagcttgtgtctggtttgccctgggcttcattccgtgtaattcccatcactgattctgcctcacctcctttgactgtcataaatcacccatgagcacaactgcatgccaaatcctcctagcaacttcctgaacttaagggtgctcttggagacccctgacatgctgtctgttataaagagggtgttctgcccctgccggggtttattgtctaaaggaaggcagtgtttgttaactctggggcttttgagatggtgagtggccatgtagagaaggataatgtctgaagaaggtcgtgataaatggggacaagctgaagactgataggtccagagaagaaaagagggcaatctcctaggattttgaatttaagaagaaaaaaaaactcatgaaaaactggggacaatccaataggcatgagatggaccaggcaccaacttctgattcagaggacacaggattgttttcctttgcaggaaaacgggatctttttttttttttttattctttgagacagagtctcgctttgtcacctagactggagtgcagtggtgtgatctcggctccctgcaacctccgcttcccgggttcaagcgattctcctgcctcagcctcctaagtagctgggactacaggcgtgcgccaccacgcctggcctgggatcttttttatcacgaatattcccaaccaccgtataatgtgaggctcccacatatccacacctatgaggccggttgcatagccatgctgctgcaagattcttgcaaaagtggtttcgttctcagggagtccacctgagcctgcgttccactgaagggcccggtatccattgctggcgtccatgcctgtggggcagagaagacaggaagaatttactttcctttctctagaggagcacttctcaaccagagggatttggtgtctgagatctggatttgtgcacccgagccaggctgctattatctatcatccatctatcatgtatggagctatcaattatctacccatctatcgtctgtcatctatctacctacctacatacctacctacctaccgacctatcacactattctcgaaataataagcatggccaatgtctggagatgtttgtggtgtcacagctcagaaagggtggtgtgtggtgctactcgtatcgggtgcgtggagccgagtgatgctgctcaagaccctacatacagtgcacagaacagccccaccacagagaatcatctagccccaaatgtccctcatgccaaaacagagacaccccaccttaggatgacagacgccatgtgatctatcatatgtctatctatctgtttacctagctatcacctgtcacctgtctatctcaatatggatccatcatctatcatctatatctatccatctatctatgtatctattatctgtcattatcattaatcatctagctatcaatcagctatcattatctatcatctgtctatcacttatctttctatcatcattatctatcatctatcattatctatcaatcatctcttatctagctatctagctatcaatcatctatcacgtcatgatcaatcatctatcattatgtatcatcatcatctagatatctagctatcaatcatccattatctatcattatcatccatctagcatgtatctagctgtcaatttatctatctatctatctatcatctatcatctatctatatcacaatgattctcaacttggggaaactttgctctctctaagagacacttggtcttgtgatcagtcatactggctcggaataaacctctttaaaatattccacagaccttggtttttctgttcacatcctaatgatcacaacttttatgtgtatgcacacaatacaatattccttacataaatacaaggaagacgatgaattgcaggtgatctttgtaccattgcccctgtatcttcaccatcagtactcaactgttacagatgacagaatgagtgcacacagatgtacccatttctccatcatctccgtgacaccaacctgatctgaaggaatgtctccctgtgaggaatgcagctcggcttggggtgcagagcggggcggccgccaggtgctgagtgagcctcacaccttcctctgcaagctggtcaatattcggcgttctgagcaaagcacacaaatgtcattgttggaagggagacatgcatttggcttaagcagatccctgctctgaaaggcacaggaatagctgcaaggacttcaccggatttcagaattagttgcattatggtctcctgcagcggtagattgaccccatcctaagtttggtgttgatgttgagatggatgacatctctctctctctctctctctctcacacacacacacacacacaaagtatatgagacaatttatgactcatataacgaggctttctggggagagcagggcaggccttccaagctcatgtgaaataaggaagcaaggaaaggagatttatgttttcaattgtggtgagggtgtggggccgagatgagggttcccatgcaagggtgggggcgtttatggtctgaatctgccatcagcaccaaaggagacagtccctgtgctttcttatctgcttgtccagatggggaacacagacagaagaggcttaaaagctttcatcatcagatatcaaaaaactgtgagggccgggcacggtggctcacgcccgtaatctcaactctttgggaggcctaggcgggcagatcacttgaggtcaggagttcaagacaaacctagccaacatggtaaaaccccgtctctactaaaaaaaatacaaaaattagtcaggcaaggtggtgcacacctgtaatcccagctactcgggaggctgagacaggagaatcgcttgagcccaggaggcggaggttgcagtaagccgagattgcaccactgcactccagcctgggtgaaagaacagagtgagaccgtgtctcaaaaaaaaaaaaaaaaaaaaaaaaaaaaagaaagaaaagaaaagaaagaaagaaagaaagaaagaaaaggagccaaaagaggtatccacatagaatggaatctatggaatatgactcagccactgcaaggcgtgaggcacggtactgtgaaagcctcctgacataaaagaccacaggttacataattccatctgtatgaaatgtccctaacaggggaatctatagagatggaaagtatattagtggctgccagaggctgagggttagggtgctgagagagttggaggagtgttagctggggctgccataacaaagtcctacacacctggccgcttcaacaccagatattggttgggcacggtggttcacgcctgtcatcccagcactttggggggctaaggtgggtggatcacttgaggccaggagttcgagacaagccttggcaacatagtgaaaacctgtctctacaaaaaatacaaaaattagctgggcgtggtggcatgtgcctgtagtctcagctactcaggaggctgaggtgagagcctaggagatggaggttgcagtgagctgtgatcatgccactgcattccagcctgggcaacagagtgagaccctgtctcaaaaaacaaaacaaaataaaacagaaaaacaaacccagtagacatttattctctcacatttctgggagctggaagtctgagatcaagcatgggcagggctggttcctcctgaggccaccaccctgggctcgtagacaccatcttctccctgtgtcctcaggtggtcattgctctgtgtgtgtctgtgtcctcatctcctcttcttataaggaccccagtcctattggatcagggcccaccctagtgacctcattttacctgaatcacgtctctaaagactcagtctccaaatagagtcacagtctgaggtcctgggggtcaggacttcgacgtaggcgtttaggggacacagattcgctcctcgctggaggtgatggctaaggggatgcagagtttctttgggggtatgcaaatgctctaacatggtttgtggtgacagatgcacagctccatgaatagaataaaagtccctgaactgtacactgtaaacagatgaaccgcatgttctgtgaattacaaccaggcctgctcagggtgttcgaaaggggatccctggacagggggcagattgattgattgattgacttagagacagggtcttgctctgtggcccaggctagaatgcagtggcgcaacctcagctcaccataacctccacctcccgggctcaagccatcctccactctcagcttcctgagtagctgggactacaggcatgcgccaccacacctggctaattttttgtatgtttcatagagacagggttttgccatgttgcccaagctggtctcaaactcctgggctcaagtgatccaccttccttggcctcccaaaatgctgggatgacaggcgggagccaccgtgcccggcccacacagggcagactgctgcaggtgctgcaatgttcactgcaaagaagggaggccctgctctgcggggaccgctcctgaggttggcagctattgaaaagcagatgcagcctgcattctggggcggtccttctaggagaaaagcccaccaaatggaataaggagctttctcaccttttctcctgttgcagaaagcacgtgagcaccactcaagcgctctgctggtaaggttggcatagaggctactactctgtgtttgcacatgccactgcagtgggctgaatgggggtctgcgaaccgatctgtccacgtgctgaccccccaaacctgtgtgtgagaccttgcttagaaaaactgtctttggagttgttattaggtatcccgagatgagatcatcctggtttagagagggccccagatgcaatggccagtgtccttctgagagacagaggaggagacacagacacaggggagaaggccgcatggggacggaggcacaaactggagtgatgtggccacaaagccagagatgcctggagcccccaggagctgggagaggcaggaagggtcctcccctacagcctctcagggagctctgttggtgtcttaatctcctcttttagtaatccatatcagattagggctcaccctaaggacctcagtttaacttaattacctcttcaaagaccccatctctgaaaacggtcacaccctgaagtaccggcggttagggcttcaacctacaaatttggaggaggccagaatttggcccacaacagacgttgtttgcaaacgtcatcaacagaagatgagatctttacagcgggcaggccttgctgcaatggccggtgtccttataggatgaggagattaggacacagacgcagaggagaaggccccgtggagacggaggcagagactggagtgatgtggccacaagctcagggacacctggagcccccaggagctgggaaagtccggaaggatcctcccatagggcccccagagggagcccggccctgcccacacctggatttaagatttctggtctccagacctgggagaacaaatttccgttgttttaagctacccattttgtggtagtaatacattcaccccctcaccgcagttccgcatggtttaaaagggcctttttacctgttggtagttttttgttgagttctgaggccctaaggagtttcctaatttctccaggcagattttaaatgcaccattccgtcaaactcacataacatcatcaccaatagcaacaaccaactgtacctcagtgtattgttcccgtagcaaccgagatccccagtgcctagatcatccgccatgatcagtaggatatttggtttaaaggcatttgcagttttaggttcacacgtcttcagaagcaagcataaaaacagtagcaccggcaaagagtccctggagagaaaagcgaaacacagaaatgactatctacaatttggcaagggaagtaggcatttcaaggcagctcgctgggaaggcgaaggtcttaccactaaattaagacgttcagctttatgggaggttattgtcttggcctgaattcctgcactggtgtccctgggccaaaccgagggtcagactgctatttcttgtgacccaatagcgagatgcagatgaattgggaaagaagagagtttttaattctgtaaccagttacaggaggaaggcctggaaattctctcccaaccaactcaaaattacaaagctttccagagcttatataccttcaaagctatatgtctaagtgtaagtgtgcatttatctaaagacataagtgattaacttcttctaatctgtaattaagatctgagtcctgaagaccttcctctggagcctcggtgaattgacttaatctagatgggtccaggtgctggggtgattacccttatcttgtctcctgctaaatcacagagttctggggagttcctttagtccccaacaaagcttgtttgtggaggtctggggagtttcttcagacccacaataaaacttgtttaatcctaaatgggtcctgttaagaattccttcgttatcttgtcatgcttcaaaggcccaggagaggcctgggcagaactcttggtgtgcttttgttacatcccagcctgtgcataaaggcgctggttgtttcagcttttagtatgtaacttcacactcagtcagtgctgaaacagttgttacggaggcctgcattagtgagacctggcctgccacactagaccatacaggtcagaacaaactggaatggagtcacttgtgttaactgccacatcgtcaagctgaacagggaaacaggtcagttttccaaaaaacagaagatttgagtaagcaagaagaagatgtgtagttcatctgagctaacaaagtctcccgtgctttaaccctgtaagaaaagtaactttgaaacaaccaatctgctttattattcttttttttcttttttttgagatggggtcttgctgtgctgcccaggctgtagtggcatgatggtggcttacagcaacctctgcctgattctgaggtgggaggattgattcaagcagtccttgaactgcagtggataggtggtgtcttagtgttgggggatcgtggctgtgctctccggggaggacgcgaacgaggggtgtgtctcagggtgtgtgaggggacacggctctactggggggcaggggaggaataaggccatggggagggatccggtgtggccagcagggcaatggccgcggaaggggacaggacggggcgtgtcttggagggtggcgagaggcacggcagtgctgctgaggcaggagaatagggtctggaggcagggaacctaaggctttccatgccgacttcctagaagtaaattgaaaggaaaatcctaactttccttttttttttaattttaatttttattattattttttgagatggagtttcactcttgtcgcccaggctgcagttcaatggcatgatccgggctcactgcaacctccacctccagggttcaagcgattctcctgtctcagcctcctgagtagctgggatcacaggtgcctgccaccacgcccggctaatttttttgtaattttagtagaggcccggcctaatttttgtatttttagtagagacgggatttcaccatattggccatgctggtctcaaactcctgacctcaggtgatccacccgtctcggcctcccaaagtgctgggattacaggcatgagccacctcgcctggcgggaaaatcctaactttccatgcctaagtaacaaaaggaccgaaggcttccctttgaccttttctattgggtagatagtagactggctgtctgcaaccaatcggactgatttcgggtctagtcttcgtgtgcaactttgtgacttcaccctagtctctgattagttgggttttgcaaccaatcagatgtttgcacaggagtgtgacctttgtaacttcaccctttggttggctgctgcctgcaaccaatcagactgatcgcgggccaccacttcagttacatgaggtgagcatgaagtggccaatgggaaacttctagggggtatttggacccaagaagattatgtacccgggcccttgagccgctgcttggtcggctcccacactgtgacgtgtccttttgttttcaataaatccctgctttccttcttttgttgcttcattctttctttgctgggcgttttgtccaattctttgttcaaaacgccaagaacctggacaacttgcagtcacgaccctctaccggtggcactggggcgcaaatgaagctgggaatgcaggacccggcgcatctgaggaagtgcagcggggcatggcggtgctagagggtggggacatggaggcggcacaaggccaaggcgccgggggatggccagagggaagtaacggccgcgcttgtggtggagatggggacgggacagagaagtcttggggggtgaccggggtaggcacggcggtgctggggggagggcgcccaatgaagcccacgggggggaaaggggcgtgtcttaccgagcgtgttgggggagtcacagccgtgcttgggaggatggggtctgggggaaggacggggcgcgtcttagtgggatgagggggagggcacagccgtgctgggaaggcaaagggccggggggcgggatggagcatgtcatggtggggccgaagaggcggggggcgggaaggggccttcttagaaatcgggagggcgtcacagctgtgctcgggaggacggggcgttggggagggacagggagcgtcttagtggacccggggaacacggccgtgctggaaggcatcgagctggggggttgggggcgggacggggtgcctcttaggaagtggggcgggcaaggctacgcttcgggggatggagccttggggcgggacggggcgcgtcttagtggggcagagcggggggcgcggttcggggcgggtcttagggagcctttgaaggccgaatccgggcagcggtgtagctgggcgtggaaggcggaggacccagcagggcgtgaccggcccagtttccgctccctccgggtcccggccagccttcctccgccctcccttcccttcctcctttgttctctttccctgcccttccgccttcccttcagttcggtctcctccacccgcccttcgtcccctcagtcgccccccatccctgggctctgctgtctggcgtctttcccgggcacagaacgcgcctccagctacattttggagactacaaggcgccggacacaaccacgccctttacaggggcccaggctcgcccggggcgcccctcgccgtgctcgcgaccccctccccaggcccccaccctaggccttagtatgggccgcgtcccggggtcccaggcacctggcggcgggcgcggcgcgtcccctccgcgcggcggatcgcatggccgagcgctggcccagagcgcaggaccttgccctgcgcactccgcgcccgggcgccgctagtgccaaggcttccgccctctcagctgcgggatctgggccgggcgcccgcccctccttcatccgcgtcatctcctggctctcgggacctccgggacctgcgcgtggaaacaggttttcccaggtcgtcacacgggaaggcctgggctaaggagctgattaaacccagttacgattgaccgggcgcggtggctcccgcctggaatcccagcagtttgggaggccaagacgagtgggtcacctgaggtcaggagttcgagaccagcctggccaacctggtgaaaccccgtctctactaaaaatacaaaaattagctgggtgtggtagttcacgtctgtagtcccagctattcgggaggctgaagcaggagagttgcttgaacccgggaggtggaggttgcagtgagctgagatcgcgccactgcaactccagcctgggcgacagagtgacactccgtctcaaaaaataaataaataaaaataaaaaataaacccagttaggcttgagcacagggagccccttttctttttgtcaggaagggtcttaggacctacccagagcaatcaagttgcgatttcagtttctcaaagcttggtgtttgaaatgtctgttccggatgctggacttgtactctaagtctgggacggggaatgctagatgggccctttttttttgcttttattactattattattattattttgagatagggactcactctgtcgcccaggctggagtgcagtggtgcgatctcggctcagtgcaacctccgtctcctgggttcaagcgattctcctgcctcagcctcccgagtagctgggactacaggcgcgtgccaccacgcccggctaattccaattgctatttttatctttgtttctttcatcagactgctgttgaaattactccttttgattaatcactgtgccctggacccctccccatcttttctgtgactcatccttttgtttttgaatgatgctattttgctcattaccctctcacgtaatgctttttttgtatctttggctctccctttgttgtttgtttgttttgtttttaactcttttgacctctagaaagatcaaggctgagagttgaggctgcagtgagcctttgtttttgtctaactctcttgacctccagtcgctgattctctcaagccccttcatgtcttacctcatcccctcacatcccctcacaatgcaagatctggtcaaagtataaattcatattttgtaggaaatgctagcttacaaaacaatatcacatccctacctccagcccaggtgacccactttccctcaaagggggttgcttaggtcctcttccactggtcagggacaaaatgattccatagtcttcaagattaacagtactttctttttccaaggctgaggctgtcaagggtgaggctgtcaccgcctcccaaggaagtggaactaccggtgtgcaccaccacccctgacacatttttgttaatttatttttttgctagagactaggtcccactatgttgcctaagctggtctcaaactcttgcctcaagcagtcctcctgctttggcctcccaaagtactgggattacaggtgagccactgtgcctgaccagccacaagactctatgttgggtgtgtaggtgggaagcatatccaggtcctcctcaccattattctgcctccaacatttatgccatttttttttcctttgcaactcagttctctatgcttaccaaatggaatcagtaaggtaggggaggcggggtggaagtttgtgttgaaaacatagattcagaagcccctccttaaattcactgagttaggattttcataaatgagggagctgccccacactcccctgggatgagatgatgggggtgcttgttcaagacaatacagtcaggagccctactccctaaatttattcaattggaatctcccaaaatggtgctgggaattctatttagaaaaaagaccattcacttttaattggcaaatttagttcatttacatttattacgctggccatctgtctggagctagctcttgagcactgtttattgcttctctctttgccctgttactctgaaatagcttttatcagacaggcttggtggctcacacctgtaatcccagcactttgggagactgagggggaaggattgcttgaaaccaggagtttgagaacagcctgcgaaacacagagagaccctgtctctacaaaaaaatttttttaagttagccgggcatggtggtgtgcctgtagtcccagctatttgggaggctgaggtgggagagtcatctgagtgcaggaatttgaggttgcagtgagctgattgcaccgttgcactccagactgggtgacagagcaagaccctgtctctaaaaaaatttaaaaaagaacttttttatctttgagggcttcccaactgggattccttgctgagcctctgtcatgcagatggagaaggccaggccgaggcctggaaggaggggggcaggagacagcccagaagcagttctgcaaggaggtttagcaggggtggcgcggagatttgatccttggaagaaatcctatgctgctgggagttgagattcctgagaactagagagaaaagaactttgggtgcccttaggtaaattatgtaaacacactgagctgtcttgggtgcccaggatttggaaatggggcctgggggcagtaggagctggtgctccagaagtcatatttgcgggaggttgtggggatggaaagggtgggtaagccctgaccctgagggtctcacatgactttcagcacatggagcctccatggggactttggcttcaaagccatcaagctcaagagtgtgggcaagtgtggagacagaggtgactctccccagtggatgctgaagaacttaaaggtgactctgtgggccgggaacatcgggcacagctgacccaaagtgctggtcttgttccataagccatggctatggggaaagccataggggttaactggttcttcctgccatccctccctccctttcttcctttttctttttgcttctttgctttccttccttcctgccattttttccttcctttctttttagagatgaggtctcgccctgtcgcccagtggcacgatcacagctcagtgtagccttggacactttgggaggccaaaggctcaagtgatcctcccgcctcagcctcccaagtaggtgggactataggcacgtgtcaccacacctaattatttaaatgttatgcggaggcagggtctcgctatgtcaccccagctggtctgaaactcctggcctcaagccatcttagtgccctaaagtgctgggactacagatgtgagtcaccgcacctggcctactatttctttcttgacccaagagaattggctggagatggatttgactttttggtctgtatgcacagcctgaattcttggaggctgatgtggattggataatttgaggacatgttcttgaggcggtgacaaggtggggcattgctcgtcacatacctaggcttggaagagtgggaggagggacctgttgcttgaatctggagacagaaagagctattggaaagacctccttactcccaggggagaatgtgctggggactgaattgtgttgccttcaaactcacaggaataaggtttttattcatcctttaaaatgaggtcacaagagtgggccctattccaataggagtggggtccttataagaagaggagattagggccgggtgcagtgactcacgcctgtaatctcagcactttgggaggccaaggtgggcggatcacttgaggtcgggagttctagaccagcctgggcaacatggtgaaaacccacctctactaaataatacaaaaattagccgggcatggtggtgcacgcctgtagtcccacctactcgggaggctgagacaggggaatcacttgaacctgtggcagaggttgcagtgagctgagatcacgccattgcactccagcctgggcaacagagcaagaccccatctcaaaaaaaaacaaaaaacaaaaaacaagaatcagagataggacacagacaggcacagagggatgaccgtgtgaagacatgggaagaaggcagcagctgtgaaccgagaaacaggttctccccagacacagcttccgtcacgccgtggtcttggacatccagcctctagaactgcaagaaagaaatattcttgatgatacccagtttatggtattttcattctagcagcccagacaattaaggcgcagcctgattatgcaatgaccttgcagctcagagctggggcgaacacttcctgcacagcgcggcttccacagccagagtttgcccaaatcacctggggcattggagacaaaggaaaaccacttgaaaacagttccaacgggaagcacggctcatccttgtggccgtaaacgataaacaaacactataaatgggcaccacagacaaagccacatcagtgccagtttttatctttggggcctatctcctgttcatgtgcaaacctgtaggtcacagagacacctttgctgggacttgtgctgttttgggctacagggcagcctcttccagactgagctggggtccattgacagactcctccccgactgcaggagatactttgcctctccagtttggtgtctgagtgatcattcaacggtgcattattaatgtttgtttgtttatttatttatttttgatgagacagtcttgctctgtcacccaggctggggtgcagtggtacgacctcagctcactgcaacctctgcctcccggcttcaagcaattcttctgcctcagcctcctgagtagctggcattataggcgtgtgccaccacacctggctgctgctgctgcttttttttttttttttttttttgatagagacagggtttcaccatgttggtcgggctggtctcgaactcctgacctcaagtgatctgcctgcctctgtctcccaaagtgccgggattacaggcgtgagccactgcgcctggccagtgtttattgttcatttctactttctcttgccttttcctttgtttttcacagggggaaactattcatccttatgcaaatagatatcttaacatgacactgaagtttgtttcatttttttgttttctttcttttttgagacagggtcttgctctgttgcccaggctggggtgcagtggtacaatcatagctcagtacagcctccaactccggtgctcaaatgatcctcctgccttagcctcctgagaagctagaactacaggcgtgtgccaccatgcaggctaattttttttttatttttgttttgtagagctagagtttcatcatgttgcccaggttggttttgatcacgggagtgatcctcctgtggtggcctcctaaagtgctgggatgacaaccaccatggccagctggtttgtttcaatttgagtgacaaaatttaggaatcggggctccagcttttcactgcagacatttattgtgggtcatcttccctaaggcaccagcagagggggaacgggccacagcagggctgcagccacggtctccagatgttgcccagcctgtccagctgcagaggaactgggctgagtgtccgctggtgttcccacaccgcctgctggactcgttccatcacctgatagaacacgggctctgaggctggtgtgaggatgtgggtctcagaagggtctcttgagaggtcaaagagcaaaggtggatcgtggtggactactttttccccaaagcacgggcagacctttcttccatagcaggcaccggctccctctggctggaacacaggcgtcacaaagtggactttccacattgttcctcctggtggaaagataatcattacagagttggcatagagaaatagggtgccttgctggagaatggcatcttcatagggctaaaaggtaggcctaacccaagcgtccatcgatggatggacagataaacaaaacatggtacatcttacatggcatactctgcagctatgagaaggaatgacacaatgacacaggctgcaacatcaacgaactttcaaaatactacgctcagagaaagaagttacaaaagagcacacattgcatgattccattcacattgaatgtcaaggatagggaaacacataatgacaggaagtagagtagtggtttccagggtctgcagggtgtgaaatggagagtgactgctgataggaacagtgtctgcttttggcgtgatgaaaatgttctggagctacatagacgtggaggttgcacaacactgtgaaagcacgaagtgcctgtgaattgcactcagtcagttttttcttttcttttcttttcttttctttttttttttttttatttgagacagagtcttgctctgtcgcccaggctagagtgcagtggtgcaacctccgcctcctgggttcaagtgattctcctgcctcagcctcacaagtagctgggattacaggagtgcgcctgtaattgttcacaaagaagatgaagtcgtgttaaggtcaggtgattaaaacatttggaagcacatctagatgcataaaatagactacaaaaggctgggcgtggtggctcacacctgcaatttcagcattttgggaggccaagatgggtggattgcttgagcccaggagttgcctgggcaacatactgagaccttgtttcaacttaataaagaaaaattggagaccaggcgtggtggctcatgcctgtcatcccagcactttgggaggccgaggagggtggatcacttgaggccaggggttcaagaacagcttgcccaacatggtgaaaccccatctctactaaaaatacaagaaattagccaggtgtagtggtgggcacctgtaatcccagctactcaggaggctgaggcaggagaatcacttgaacccgggagactgcagttgcactccagcctgagcgacaaagactagtctcaaaaaaataattacaaaaaaataagaaaaaaaagagactagaaaagtcttgaacacatgtgtgtgcaagcatgtgtgcgtgcgtgtgtgtatgcatgcacatacgtgtgtgtgatgatgataaaagttgcacttcatatagtgcagggaagaaagaatgaaatatagcccatacatggtgctgaaactataggtaacgactccccatcgttttaagacgattggcaggtgatctcagaaggcatgtcgctggaatgagagggacacatattgacaaaaactaaatttaaaaagctcgtggagaaaaacggaagtgcggagacatggagatggactctggaatgcagctccatccctagcctgttctagggcatggtgctttcctgcacagagggactctttccctaagggtgttaggaaggggctcccctactcactgtcccgttgatgccacctggctgcgtgcagaaacctctcacaataatgcatcaggaactcgtggtctgagtgttgggctgtccccaggagcaagggcagaaggtcttggccgtcaatcactctgcaggaaggaacatggcatggctcagggttggaacagggactctggacatttgtccctccagcatccaccagtcccagccccaggtggtgcactctccttatgttgtatcagtggagggaaagtctgggtgtgaacgcagatggatggaaggcatgtgtgtgcattagcacgcttagaagaagaatgcagcagctgcccacgttagtcaccaccaaacgtcacctttggctaaaaagtaattaattggccaggcacagtggctcgtgcgtgtaatcccagcactttgggaggtcgaggcgggtggatcacctgaggtcaggaattcgggatcagcctggccaacatggtgaaaccccgtctcaactaaaaacacaaaaattagccaggtgtgctggtgtgtgcctgtaatcccagctactcgggaggctgaggcaggaggatcgcttgaacccaggaggcggaggttgcagtgagcctagatcgcaccactgcactccagcctgggcaactgagtgagactcagtctcaaaaaaaaaaaaagaagaaaaaaaagctgaaagagccagcacccaaaggctggaatgtaacaaaagcccactaagagttctacccaggcctttcctggaccttgaagcgcgataaaataatgaagggattcttaacaggacccatttaggattaaacaagttttattggggatctgaaggaactccccagacctccacaaacaagttttattggggggtctaaaagaactccccaaacctccatgatttagcaggagacaagataagggtaatcaccccagcacctggaaccatctagattaagtcaacttactgaggctccagaggaaggtcctcaggactcagaccttagttctagatgaaaggaagttgaatcacttatgtctttagatggatgcacgcttacatgtggacatacagcttagaaggtatagaagctctggaaaactttgtaattttgagttggtctagtgatcatttccagccttctccccgtatctggttacagaaataaaactcctttctttcctcgttcatttgcatctcgttattgggccatgagaataagcagcccgaccctcggtttggtcggggaacaatttcagggacgccttactgcaaagccaaagtgacatgttcatttgccataagtgttgctgtgtctgtgcaaagctgaattgtttctttgggttgttctgtacctgtcctggggcacctcgccgcccgccagccggaccacggtggggaacacgtccatcagactcgtgggctcgccaatcactcggccggccgggagcaccccgggccagcggaagatcccgggcacgcggatcccaccttcccatcctcccatgcccttcccacctgggtttgaacagaaacaaaagaaagtggttaaaaaccagaaatagatgctcagcctggctgatttaacttttctgcttgtttcacttgtttgaagtttctctctccctgagtctctcaatttctctctctctctctctctgttttagtgacattaaaacattcaatctcatgtagttcccctgtagaggtttgattttatattttttattaaccttgttattggttagtgtgcattggattaagttaggtccttcactacaaatgactcttgttcttagaagacacagacacagaggagaaggccatgtggagacggaggcaaagactggagtgatgtggccacaagcccagggactcctggaacccccaggcgctgggagcagcaggaaggatcctcccctagagcctcaagaagaaagtggatacaactataacgtattgaacagtgaccccaaaacatgttcatgtcatatctcccagagcctataaatgagactttatttggaaatagggggtttgcagatataatcaagttaaggaccttgagataatcctggattagggtggccctaaatgcaatgacagatgtccttctaagagacagaagaggagacacggacacagagaagaaggtcacgtggagacagaggcagagactggagtgatgcggccacaagcccagggatgcctggagcccccggtaactgggagaggcaggaaggagcctcccctagagcatccagaaagaagtggattcaattgcaatggattgcactttagtcctcctgaaacatatatccacaccctgatccccagattctgtgaatgggaccttattttaaaaaggggtccttgtagatgcaattaagtatctcaagatcgtcgcggagaaggatggactctaagtccaatgacagcattctaagagacagaagaggagacacagacacagaggagaaggccacatagagacggaggcagagactggagtgatgtggccacaagctcagggacacctggggcccccaggagttggcagaggcagggaggagcctcccctagagcttctggcgggaacatttccctgagacacgttgatctcaaactcctggtctccagggctgggacaggataaattcctgttgtttaaagctccgccagtttataatactgacattcttgatggcacagagaaccagattgggtagaggatacattaacgtcaatggcaatgagataaagaaggtttctgaggagtcaggccttcaatgtgaagttgttgtgggaaggcattagtggatgtagttggcatttatatatcccgttttacatatgtactagactgatggatccatctacttcaaagcaaatatacatcataggtatatttgccaatattagcctaaaaaggctctttcaaggactgaaaaataaagctctctaagcagggagaagacaaaatgtgtaagcacaacagtgtgaagtcatgtacacggggcagcacattttagcatctttgtggtacacgaaagaatggcgtgtttggaaacaatggaatacaggtttgaatataatgtggccagctaggtgtctacccttctaccttttttttttttttttttttttttgagacagagtcttactctgtcacccaggcgagagtgcagtggcacaatctcagctgactgcaaccttcacctcccaggttcaagcaattctcctgcctcagcctcctcagctgggattacaggcgtgcaccaccacgcctggctaatttttgtatttttagtagagatgaggtttcaccatgttggccaggctggtctcaaactcctgacctcaagtgatctgcctgcctcggtctcccaaagtgctgggattacaggtgagagccactgcgcctggccttatccttcttggatgcattgtctgaaggtaaaattcaaacctgagtccacacaatggaatatattcagccatggaaaggaatgaaacatttccacaacacagatgaacctcagaggcatcatgctaagtaaaaacaaaaaaactccacatattgcatgatttcatttacataaatgtctagagtaggaaaatatacaatgatacaaaataattttgtggccaggcatggtggctcacgcctggaatcccagcactttgggaggcccagctgggaggactgcttgagttcaggagtttcagaccagcctgggcaacataacaagaccctatctttacaaaagataattttaaaaattaaataataaacaaatcaaaaataagtttttgggtgatggatgttagcacgggggaaaagggagtgactgctatgagtagaggatttttttgtgaggtgatgaaatgttctgaaataaacagtggtggaccacatgtggtggctcatgcctgctgtcatcccagcaccttgggatgccaacgtgggaggatcacttgaggtgaggagtttgagaccagcctgggcaacatggcaaaaccccatctctacaaaaatacaaaaattagccaggagtggttgcatgcacctgtagtcccagctacttatgatcgctgagacaggaggatcacttgagcccaggaggcaaaggttgcggtgagccaagatcgtaccactgtactccagcctgggagatagagccagactgtctcaataaaaataaataaaaataataacaataaattttacgaatgaaaatagtgattgtaaaacaaaaataaaattctaaggacccccaaccatctgaatggacttcctcctcacccagagctctttaaaaacttaacctgagaggctgtttcaggccgtgacaggaagcgggagtcgaacatgcctcatgattcctctctggcattaacatccacacagcctttaggtctgataagaagcatgttacaacctcttgtctctgaagcctagtacctgaaggcttcctctgcaaataagaacttgggtgtccacaatctttttttttttttttttttttttttgagatggagtttcgctttgtcgcccaggctggagtacagtggcacagtcttggctcactgcaacctccgcctcccaggttcaacggattctcctgcctcagcctcccaagtagctgggattacaggcacgcaccaccacacccagctaatttttgtatttttagtagagacagagtttcaccatgttggccaggctggtctcgaactcctaacctcaagtgatccacccgccttggcctcccaaagcgttgggattacaagtgtgagccactgtgcctggcctccacaatcctttatcttaacccagacattcctttctgttgatcccaggtctttagagaaacaacgaattgtcaaccaggaaatgtttaaatctacctgtaggctggaagccccgtggctttgagttgtcccacctttctggaccaaaccaatgtgtctcttaaatgtatttgattgctgtctcatgcctccctaaaatgtataaaaccaagctgcgccttgaccatcttgggcacacgttctcgggacctcctgagggctgtgtcacaggccatggtcactcctatttggctcagaataaacctcttcaaatgttttacagagtttagctcttttcatcgacatgatgatggttacacaactctgataatctactaaaaattccttaattgtgcacaaaaacgtggcaggccacgtctcactaacacaggcctccgtaacaactgtttcagcactgacgagtggtgaagttaaatagcaaaagctgaaacaaccagcgcctgtatacaaaggccgggatgtcacaaaagccccccaggagttctgcccaggcctctcctgggccttgaagcgtgacaagataaccaaggaattcttagcaggacccttttaggattaaacaagttttattagaggtctgaaacaactccccagacctccgcgatttagcaggagacaaggtaagggtaatcagccctggcacctggacccatttatttatttgtttatttatttattttattatttttgttgttgagatggagactctctctattgcttaggctggagtgcagtggcgcgatctcagctcactgcaacctccgcctcccaggttcaagcgattcttctgcctcagcctcctgagtagctgggactacaggcgtgtgccaccatgcccggctaatttttgtatttttagtagaggcgaggtttcaccatgttggccaggttggcctcaaattcctgacttcaggtgatccacgcacctcggcttcccaaagtgctgggattacaggcatgaaccaccgtgcccggccacctggacccatttagattaagtcaatttacttagtctccagaggagggtctccgggactcagaccttagttacagattagaagaagttcatcactaatgtctttagatgagtgcacacttacacgcagacatacagcttagaaatagaagctctggagaactttgtaattttgagttggtctggcaacaatttccagacctccctgtaaccggttacagaaataaactccctcctctcccagttcatctgcatctcatttttgaaccaccagaataagcagcctgaccctcagtttggtccaggaacaaaaattcaaactggagtatgtcaaattaccacttttgccctggataggaaaaatcactgtccctgagcaataatattgaccctcctggaatagattgccctgctgggaattgcagggaagagataaacttgcaagatgaagatctgggagcatctcagtcttacctttataaattccattccagccaccatactgggtgtttccaagttgattctctagggaaccgccgtgatccgacgtaaaataaatgagggtgctgttgctcaaaccctccacgtccaaagtgtcaaggatccgtcctgcaaagaacagatgtttttggggccgtcgaaatggaaaaatatcagaaatgcagctctgaagtgtatgctttagcattcgggggctagccacaagaatgaagccttagttttaacgcataatggaagtcagctgttggataattttgatatcctttgttggagattgatgtatgactttatatgcaccccatcctttggtcagaattttaggcaacgtacaaggacaaaatatcaaaaacttaaaagtgcagcatgcaggctgggcacagtggctcacacttgtaatcccagcactttaggaggccgaggcaggaggatcatttggggtcaggagttgtagaccagcctggccaacatgatgaaactacatctctactaaaaatacaaaaattagccgggcgtggtggcacatgcttgtagtaccagctacttgggaggctgaggcaggagaatagcttaaacccgggaagtggagattgctgtgagctgagatcacgccactgcgctccagcctgggtgacagagtgagactcggtctcaaaaaaaaaaaaaaaaaaaaaaaaaaaaaagtgaggcatgtgaatattcctgagaagaaagcatagactgaaaatgcagaccagtcctcaaaagtgaccctgagcttcttgcagccacacacaagggaactcatgtcattaatgtcactcacagttggccgggcacagtggctcatgcctgaaatctcagcaatttgagaggctgaggtgggaggctctttgagcctatgagtttgagaccagcctgaacaacacagcaagaacttgtctctacaaataataaaaaaattagccgggtgtggtagtgcacacctgtggtcccaggtacttgggaggctgaggtgggaggattgcttgagcctgggaaggcagggtgcagtgagccacggttgcaccactgcactccagcctgggtaagagtgagaccctgtcggccaggcgcagtggctcatccctgtaatcccagcactttgggaggctgaggcgggcggatcacaaggtcagcagttcgagaccagcctggccaacatggtgaaaccccatctctactaaaagtacaaaaattagccaggcatggtggcgggtgcctgtaaacccagctactccggaggctgaggcaggagaattgcttgaacccgggaggcggaggttgcagtgagctgagaccgtgccattgcactccagcctgggcaacagagtgagactcggtctcaaaaaaaaaacaaaaaaaacaaaaaaaaaaaaacaaaacaaaaagtgagaccctgccacacacacacacacaattaactttttctccttccatgcctagcttgttgaggaaacaattttttttttttaaatacgtcgttcacccaaatctctgatggcaattattctgaggatcctgggattcgcagcccaccaccacctaaaccctgcggttcctaagttcttttttgggaggcagggatgtgctgtgcccatatacaggtgctcacccagccctgactcactcaagcaatattccccttccatcctgttctaaacccaggaaatataatgagggaatgaggcaagacaatccggccccacaggagtttatattcccctgggggaaatggaaaatcaacctacctaacacatggtcacgaagagaagcaatggtgatgctgtgttaggaaaaaaagaagaaagaagacagaaagaagaaagaagaagaagaggaagaagtggaagaggaagaagaaggaggaggaggaggaggaatatgaagaagaagaataagaagaagaagaagaagaagagggggaggaggagaaaggaggaagaggaggaggaaaacaaaggcaaaacaaaaaaggaccacaggagaatgggggagaagatgattggggaggagctactttaggggtgcgtcagggcaggctctgaagaggagccagtgaagcctgaggaagcattccaggagggaacagcaggtgtggaagccctgacaggggacaaatgtgaaagatactgtgtggcgtccacgtggccagaatgcagcaggtggggaggacaagggggttgggtagaggtcagactaggatctgggcagcagcaggtcatggggcttttgtaggtgataggaggaaatttagtcctattttcagtgcagtggagccactagccactctacagcggagaggaattttatctgctctttcttttgtttgtctaccacatggcaataggacgtagacatctttggggccaaaattctgtatgccacttgggaattcagacgtggaaatctctgaggtcattattctctctaacacatggggattaagacgtggacatctttggagtcattattctgtctagcacatggggattaggatgtggacatctttggggccattattctgtctcccacatggggattagaaagtggctatctttggggccatttttatgtctaccacatcaagattaggacgtggatgtctctgcagccattattctgtctagggagtggacagctttctgccacatgggattaagatgtggacatctttggccgaatcgcattgcctcccgtgcatgtgttatggaattcaccctctgctaatgcagtgaagatctgtgctataatattttgcactcttaaaatccaatcgcactgcaatcgctattctgcatcttctgtctttaaccttctcattctttgtttcctttcctgcttctattgctggaagggaagcagcccattttccctggaagtgcacttacctaccatccagtccatctcctctacgttgtccccatacagcccgtggagactcttcccgaggaagttctccatagtgataagagggatgtgaacgtgtagaaaggaaacaaagaggaggaaaggcccatgcttattcctaaaaataaatacgaagcaattaaggtgacttttttggtaaaacagagattgaagtcctgtagatactaaatacggatctcacttgtcacatcattactcaaatgtcttctcaactctgctcaccaaaaagaaacactcaaaactcttcttcaacggaaaattaattcttatatttaacaatcttccttttttttttttttttttttttttggctattttaaagacagggccttgctctgttacccaggctggagtgcagtgacatgatctcagctcactgcagcctcaatctcccaggctcaagtgatcctcccacctcagcctcccaagtagctggggccacaggcatgtgctaacaggcccagctaatttttttttttttttttttttttttttgtagagacagggtctcactatgtttactaggctggtcttgaactcctcggctcaagtgacctgcccctgcccatctcggccttccaaagtgttgggattacaggcgtgagccaccatgcctttctggtctgttacctctctctgtttttcattttgagacggattgtggctctgtcgcccaggcgggggtgcagtggcacgatctcagctcactgcaacctctgcctcccaggttcaagcaattctcctgcctcagcctcccaagtagctgggatcacaggcatgcaccacaacacacgtcttgtttaagactctttaacatcatgacttttcccttcccttctgaaatctatttaaaaatccacactgggccaggcgtggtggctcacacctgcaatcccagcattttgggaggctgaggcaggagcattgcttcagcctaggagttcaagaccagcatgggaaacatagcaagaccccatctctactaaaaatacaaaaattagcgggatgtggtgacatgcacctgtactcccaactgctcaggagggtggggtgggaggattgcttgaccctgggaggaggaggttgcggtgagctgagattgcgccactgcacttcagcctggacaaccggattgaaatcctgtctcaaaataaataaataaataaataaaaacccacactgatctaatgcatcttttcccccccgaatattataatgttctaactctactgcttaatgcaaagttaaaagaactgtaggttactgacatgacttttattttgttcaattatttcaatatctatttttaacctcaagctttagcttatagaataagtggtgccacacattccattttctttataattgctatcacgtagtgaggattaggacataaaatagttataaaaaacacactttacaaatgaggcatattgggttattcatattatttccattgtcctccttgaaagcagtgttttagcttctccctcccttcacccggccttcatggtctaatctagatccttgaagcctaagagcaatggtgaaggtgttagccttaattagaacacgtcaggctgggcatggtgtctcatgcctgtaatctcagcactttgggaggctgaggcaggaggatcacttgagcccaggagttcgagaccagcctgggcaacatagccagatcctgtcacatttaaaatcaaaaagaacacaacagtcttaccctgctttaatttgcaagctaattgtcaatgtcctttctgtcatacattaggtattgccatgaagaactctctaagaggctggatgcagtggctcacgcctgtaatcccagcactttgggaagccaaggcgggtagatcacttgaggtcaggagttcaagaccagcctggccaacatggcaaaacccatctctattaaaaatataaaagttatctgagcatggtggtgcatgcctgtaatcccagctacttgggaggctgaggtacaggaattgcttgaactcaggagcggaggtcgcagtgagccaagattgcaccactgcagtccggcctgggccatagctcgagactctgtctcaaaaaaaaaaagaaaaaaattatctaagaatgttgtaggagatgatgacaacctcattgtcaccaggtaaggtgacttttgatggtgttaccatctttactagaatgcccttggggagcatgaaaatagctgtgtagtactgagaactagtttcatcccatttctcctggtcccacacaggaattttccttgccataaaattgaccgcaggctgaattctgccaaaagacatctgacttctgaagatagacttttttttaagtttataattgattataaagcccttcaggtgatgcaggttacttaaatagtgtctgtggtgatccgaggatgctaatggaataagactgaccccagagtagtagcaaattccagctgacctgtaacaatttctttttgagacaaggccttgctctgtcgcccaggctcccttcatagcctcactacatagcctcaacctcctgggctcaagtgatcctcctgcctcagcctcccaagtagctgggcctacaagtccatgccaccacagccagctaatttttaaaatttttgtggaaatggggtcttgctgtgttgtccaggctggtctctaactcctggcctcaaattatcctcttgcctcagtctcccgagtagctgggataacaggtgtgtaccactatgcccagctcagctgtaacaatgttttaatggacacaaggcaagtcacagggctccactgaccctcatctatgccccattcttaccaaaaaattgtccttctaggtcatggctatcccattcttcaaacgtcaattaaagaaaacgactttttttttttgagacaggttctccctgtgtcacccaggctggagtgcagtgatgtgacctcacctccctgcaacctccacctcccaggttcaagggattctcccacctcagcctcccgagtagctgggattacaggcatgcacctgtaaagccccacattgggctaatttttgtatttttagtagagacggggtttcaccatgttggccaggctggtctcgaactcctgacctcaggcgatcctcccacctcagcctccaaaagcactgggattacaggaatgagccaccatgcctgactgaagaagactatttaggatgcgttttcattccaaagctgagtgcttggaggaagctgacccttttctgctgaccttttgagaaaggacgcaacctcctgcagaataaggggtgtcgttctttggaagcacatgggctgctccgtgatggtgtggtttctcatcagaaagcaatcggcatggacaatcagagcacccacaaaataggagcttgcgaggaggaggacggccgaaagggctgaccagatgaccggcatccacgagacgggtatcaggtgtgtgagcttccctgctaccagtgtgagggcaaccaaggccaggacttggaagaggaagttgagtttttgttccaggttgacacgcttctctgagagttcccagcgggcgcaatcacccatcaaggagaaaggcattccgtagaaatggtcaaagccatgatggagagggtggtggcaatgatcactggctgactcacagttgagacccagatgccattttcctgagaggcaaaaaggatgttgatgtgacaagcatctgagcataactggacatgtcgatattgactgtttgtcacattcctgatactctgttagacactggggggccaggagattgcaaagaagtgtgggcagcattagctgttatttgcaccacaatctggcctcatcgtttcaggggaatgaggaccccatgtgtcagctttaaccaaaatattagttacccgtgacaggtggaacaaattactgtaaaactgttcacttaatacaacagaaatctatcctctcccagtcctagagaccaggagtctgagatcaaagtgtctccaggccacactcaaattggaggctctaggggaggatccttcctgcctctcccagctcctgagggctccaggcctccctgggcttgtggccgcatcactccagtctccatctccatgtttccatggcgttgtcctctgtgtgtgtctgcgacctaatctcttgtctcataaggacagcagtcatcgcagtagggcccactgtagagacctcatctttacttgattatatctgcaatgactctattgtgagctggatcctggcctgcctcaaattcatgagttgaagccctaacacccaggacctcagaatgtgactgtgtttggagacagggtgttcaaaggataattaatgtaaaatgaggtcattagtttgggcactgatatggtttggctgtgtcctcatgcaaatctcaccttgaattgtaataatccctatgtgtcaagagtggagccaggtggagataattgaatcatggaggtggtttcccctacactgttctcatggtagtgaatgagtctcacaagatctgatggttttataaatgggagttcccctgcacatgccctcttgcctgccgccatgaaagacatgcctttgcttctcctttgccttccaccatgattgtgaggcctccccagccatgtgaaactggaagtccattaaacctcttttctttataaattacccagtcttgggtatgtctttattagcagcgtgagaacagactaatacaggccttaatctgatagaacttgtgtcctataagaagaggatagtaggacacagacacacacatactctctccagaggctctaggggaggatccttcctgcctctcccagctcctggtggctccagctatcccttggcttgtggtcgcctcactttaatcacactgctttctcctctctgtggcccaatcttcctctacctccatgttaaacgaagccttgtccttgcacagtgggcccagctggataattcaggatcatcttctcacctcaagattgttcacttaatcacatttacaaagactctttttgcatataagctaatatttgctagattcagaggttagggcctgacatctctgggaccattatttagtctattgcaccttgttttgcagtgcaatgatgaaggccggaaagcaccatgtgatatcagcagcatgggcaaaagacttctggactttggaattgttctctctttgagaaaccactatcatagtggccatggttgaagtgggtggtgggttttgcaaggcacacctttcaaattcagtcaaaggaatatagtctttgcttccatgtagccactactatggtgttgacaaagagatgtcaaccaccccaatgctgtctgccatctggaaaacctcatgatttcccaatggatatcccttaaggatagactcttctgtcttagaaaaattatagttggccaggcatggtggttcacaactataatcccagcactttgggaggccgaggtgagaggattccttgtgcccaggattgctggagaccagcctgggtagcatgggaagaccccatctctacaaaaaaaaaaaaaaaaaaaaagaaaaaaaagaaaaaattaaccgggcatggtggtgcaagcctgtagtaccaactgcttgggagactaaggtgggaggatcacttgagtctgggaggtcgagactgcagtgagctgtgactgcaccattgccctctagcctgagtaacagagtgagtaccctgtttaaaaaaaaaaaaaaagtctattggaaaaaatacacctttgtttgacagcgatgactgaatctccccagaatttgttttttttttttttttggtaaaaaattaaacaaagaacattttataatttttaatttttagaaatatagtttattgaattttatactcattgtatccactagtcatgttgtttgttatcaataaatggaactgttgataacaatcattactataacacaataatgataatggcaacttggtctcctctcaaggaactgttgtcattaattttatttttcatccaatacatgacatgtttgttgacttgtagaaaaataaccatgttagttatggaagctgacagggaggtactaaatctagtaaagacattttcatacacaccaaggggaaaaataggtagcattacagaaatttttgatgcaagaatatattttttcttatttttttttatcatggcctacgagaacattgtttgagatgccaaatatttcattaagttgatgttccttttctttctttctttttctttttcgtagagacagggtttcgccatgctgcccaggctggtctcaaagtcctggcctcaagcgatccacccaccttggcctcccaaagtgctgggattacaggcatgagccaccgcgcctgaccagagtcacttttgtaagggcactaatcccacacatgaggctccaccttcacgacctcatcacttcccaaaggcttcacctcctgccaccatcacctggggggtaagggtttcaacataggaattttagggggacacaaacatttagatggcagcactaaactagccaagttgatccataaaccaaccagaaaagagctgaaggtgttcagtctaagacattcatgtctaagacaaaaagtccatgtgaagggtgggagaggatcccacagaacaaagaagcaattatgtgttgtgcaatggagcttggaacatatgccataggcatgagcacattttatttattttttaatttatttttatgtatttttttgtagacgtggggtcttgctatgttgcccaggcgggtttcaaacttctgggctcaagcaatccttccgcctcggcctctcaaagtactgggattataggcatgagccaccttgcctgagctggtatttcttgagtatctactttgcagaaaacaacctggaaaggaacatggttcctagatacatgcagctttctgtctagtgggaaatcccacagcacctcacccactttcctttccaaactctttagctgaatgtcccttccatataaaagtcatgtgcttaccacttttaaaaacgtacataccaatgagtccagtggcatagcctttctctttcagtatttttgcaaaagttgtctcatttgttggaagacctccagatgctccggtccactgaagaacacggtaaccaatgctggaaaccatccctttgagcaattattaagagaaagaattactgttccacattttttttcctgtttgttatttattatttattcaaaaatagaacacttggtaaaaatctctcttacttaaaattaaattgaaaatggacttcctatatgactttgcctagtggattgcatttttggcagcaaagtaaatgattaatttattgaaaaccttagcgagaagatggactttcctgttatgtgcaggttataagcaatataattcagtgaaaaaggactaaaaatttaaatggttttttgtttgttaattaatttatttaaagatggggtcttgttctgtcgtccaggctggaatgcagtggtgtaatcaatgtccactgcagtctcaaccacctgggctcaaacgatcctcccacctcagctacctgagtagctgggactacaggtgtgcaccaccacacctggctaatttttaaattttttgcagagacagggtctcactctgtcacccaggcttgagtgcagtggcatgactatagatcactgcagccttgaactcctgggctcaactgatcctcccacttcagtctctcaagtagctgggactataggggctcatcaccatgcctagctaatatttttaattttttggcagagacggggtctcactatgttgcccaggctggtcttgaactcctagactcaagtaaatcctcccacctcagcctcctaaagtgttgggattagaaacatgagccattgtgcctgaactaaaaatgattttataatttcatcaaactcttgatataatctaaaggttctcaaagttgtctgcccattggaatcgtgtggggagcttcaaaatattctgacgcctggttatcaccccaggggtgctaattttcattggtcttgggtggaacttgggctttgggatggtgggaatatcctctggatgattctaacgtactgacaaggttggtagccactgataaaattttattctgctctccagacattccaaatctctacccaagggtttttttgtttgtttgtttgttttgggacagagtcttgctctgtcacccaggctggagtgcagtggcgccatctcggctcactgcaatctccgcctcccgggttcaagcaattatactgcctcagccttccaagtagctgggattacaggcactcatcatcacgcccagctaatttttgtattttcagtagagacggagtttccccatgttggtcaggctggtcttgaactcctgacctcaggtgatctgcctgcctcagcctctcaaagtgctgggattataggcatgagccaccgtgcccagcctctacccaagtgctttaaaatgtaggtgttatgtattattattattaaggttttatcattcagctatggcaaggccaacagatcaggagatgactgtcattggagagatagtttattactcacagtttctgatagtttattactcacagttcaagaggacgcaggggtgagccatgctgtgtgactatatggggaagctccagggttggtcaggaggcagagggagtgaggggaaagcatggaaaaagcctttcttatttattgtttttcttttttggaaagtaatgggcaaggtagggtaagccggcttaagactggccaggttgtacaatttccgtgggctttcatctgcaggggctgtccctagaaagctggtacctgattctggggggattagggcaaggagagagtagccccatatatgaaaatctcataaaagtgatggttgggggtgtgggctctggactgtttggtttatgcatgaaaggtgcactcccaggtgacttgtttgctatctctaagaattggctagccctgggagggccagtcctgccaaggtcagcaaagccctaagatgtcaaagcatcagaatataaaagctgcctgggcacggtggctcatgcctgtaatcccagcactctgggaggtcaaggagcggggatcttttgagcccagcatttcaagaccagcatgggcaagatagagagaacaccccccagtctctatttaaataaaaaataaaaaaaccaaaatgtaagaactagaaactgtgacgaatacaccaggctgcaccctagtgcagttgtaaagagagactgacctgatcgcacagggtatctgcccgtgaggaaggcggctctgcttggggtgcacaaagatgcggcagagatgtgttgggtcagcttcacgccgtcctctgcaaggcggtcaatattcggagtcctatggagggacaaattaacagctttacttgttaaaattagacaggcttttcataagcatagctacatgctacttcatagaaggtctgctggtcatcgctgagtgcttcaagatgttctcaggaatgacccaaaggtaatgtcaaagatttctaatgtcttctgaactttcgaggaaacatcaactcatttaaataggaatgagtggctggacgcggtggctcatgcctgtaatcccagcactttggaaagccacagcgggaggatcgtttagggccaggagttcaagaccagccgggccaacatggcgagaccctgtctctacaaaaaaatctacaaaaatagaaaaattagccaggattggtggtgcatgtctgtagaaccagctacttgggagactgaggaaggaggattgcttgagctcaggagtttgaagctgcagtgagctgtgattgcaacactgcacttcaacctgggtgacagagagacaacctgtctctaaaataaataaatgaatgagtagatagagtgactaagtttccacaaggcactgttggtactgagagaccgacctcagagggaatgcagaactgagagcccagggcaccttctctggagctcacagtgttcatgggaaggtttgacttcatggacgccaacacactgtaagtactacatgagggtggaaggctggaattcggacaggaggacggactagctctagctcttgacagatggacacgccatattttggcattaggagggtgtggacttgtctgtctgaagcagagcttttcagcaggggaggattgaaatcccgcataagtgctgggcttggctagatggatagggttgggagtgagacagagatcaatattggtcttctgcttacaggcaacgacactgatttctcctgtatgtttgtttatttgtttgtattttgagactgagtctcactctgtcacccaggctggagtgcagtggcactatttgagtctcactacaacctccccctcccgggttcaagtgattctcctgcctcagcctcccaagtagctgggattacaggtgcccgccaccatgcccagctaatttttgtatttttagtagagacgggggtttcaccatgttggccaggctggtctcgaactcctgacctccaagtgatcagcctgccttggcctcccaaagtgctgggattacaggcgtgagccaccacggccagcctactttttgaaacagggtctctgtcgcccagagtgcagtggtctgatcacagctcactgcaaccttaaactcctgggctcaagtgatcctcccacacctcaccctcttgaataactaggattacaggtgcatgccatcatgcctggctaattttttttttaatttaaaaattaatgtgccaggcgtggtggctcacgcctgtaatctcagcactttgggaggctgaggcaggcagatcacgaggtcaggagattgagaccatcctggctaacatgatgaaaccccgtctctattaaaaatacaaaaaattagcggggtgtggtggtgggcgcctgtagtccaagctacttgggaggctgaggcaggagaatggcgtggacccgggagacggagctggcagtgagccaagatcatgccactgcactccagcctgggtgacagagcgagactccgtctcaaaaaaaaaaaattaatgtttatattttctagagacaggatttcactatgtttcccaggctggtcttgaactcctggccttaagtgatcctcctgcctcagcctcccaaagggctggtattacagtcatgcccggctgatagcatttctaaagcattgtccattatgtactgggtggataaaaatcatatttaaaaaatgaaatgaggccaggcacagtggctcacacctgtagtcccagcactttgggaggctgaagcgggtgaatcacttgaggccaggagttcgagaccagcctggccaatatggcaaaaccctgtctctactaaaaatagaaaaattatccaggcatggtggcgggcgcctgtaatcccagctactctggagagtaaggcaggagaatcactggaatcgcagaggcggaggttgcagtgagccgagatcgcaccactgcactccagcctgggcaacacagtgagattctgtctcaaaaaaaaaaaaaaaaagaaaagaaatgaggccaggtatggtggtttacatctgcaataccagcactttgggaggctgaggtgtgtggatcacttgagcccagaagttcgagacgaggctgggcaacacggcaaaaccccacctctacaagaaacttacaaattacccaagcatgatggtgggcacctgcagtcccagaattactcgggaggctgaggcaggaggatcacttgaacctgggaggtcaaggctgcagtgagctgtgattgtaccagtgcagtccagcctggaccacagagcaagactttgtctcagagaaaaataaaaaataaaaataaataaataaaaataaaaatgaaatgagcagtcatatgtaggatggattgaggtgaggttagtgctggcatgggaagaaagtaacattagggagagttagaaaacgcagaagtgcagaactcttgaagtgtgaactgccaagatcaagggttatatgcattttcagtggcttctctttcttctggtgtctgcattgggggcaccaggtgagtaattctctgtcccttgcctcatggtgttgttgccatagcagccaatgtccccaatgccaaggtcgtccgccatcagaagaaggatgttcggtcgggaggcggaaatgtcgctggaagctgatggtgccaaacttagcagtacagcgagcatcgctggcagccagctcctgaaacacaaactgtcagagactgcgtcatgctcctgtccatctcatttgcagaacttgtgtatgggggaagttggcatcactattttaagaggtattgatattatcatcacatttcagaatagctttgaggacatctcttaggcatttgattgtttttctctggttacaattaactgataccgttgatggctttatttggccttgaagttttttgggttttttttgatgctgtaaagtctgttgttaagtgattaaactcatgattaacagaaagccttggtggggtgcagtggctctctcctgtaatctcagtattttgtgaggctgcagcgggtggattgctttaccacaggagttcaagaccagcctgcgcaacatggtgaaaactcatctctacaagaaatacacagcttagctgggcgtggtggcacgtgcctgtagtcccaactcctgggaaggctgaggtgggaggatcgcttgagcctgggaggttgaggctgcagcgagctgagatcgcaccactgcagggcaacagagcaaggctgtctcaaaactacaacagcaacaagaaaaagcaaaaacagccagaaagcctgccttagtcatggtttcttggatggatcgggtccccagaacagctattgccccttctccattccctcttcttcattgttcttccttaagcaaactgtgttgaacatagggaatggaggctggggttagggtttggaccacccagcagagcaaggaagagacacaagcttggggcaaggtgagaacacagtgagctgctacttctgagtctatgaaaaccctctgttcattgtagcacacagatgaaaatacccaggactgacttctttagcccactggtatctgatgagaagtgggtttggaggtgaaggaggttccagcctggaggagaaagccctggtagttgcgtaccatgagggaacatttccgcaggggttggtgacatacagcctgccactatcattgctgcctctttcatcgatgccaccctgggaatgcacatggacagcagggccatagtgtcccaatccccagtgggatgcagtaaagatgtaatctgagtctccaaggtttgtagtaggggaaaccctgattttccctggaaaaccagacacctggccgatggtagcggttgatgcccacctgatttgcagagaatgaaatacaattccttctgaggctgcctggggcaacatcaaatcaagggagcctggagcacatctattaatcacgggtctcatgcttcattctccagatgcaggataaatcactatcagtgcattctgagaaagcaccatcaagagatccagaagcggtcaggcgtggtggctcatgcccattatctgagcacgttgggaggccaaggtgggagcattgcctgagcccaggtgtttaagaccagcttgagcaacatggtgagaccctgtctctatataagaaaggaaaaaaaataaagaagggaaggaaggaagaaagagagagagaaagaaagaaagaaagaaagaaagagaaagaaagaaagaaaagaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcaggcgcctgtagtcccagctactcgggaggctgaggcaggagaatggtgtgaacccgggaggcggagcttgcagtgagccgagatcgcgccactgcactccagcctgggcgacagagtgagactccgtctcaaaaaaaaaaaaaaaaaaaaaaaaaagaagagaaagaagggaaggaaggaagagaaagaaagaaagaaagaaaggagactactaatgagtgcatataattgtatcttaccaagaatggtgcagatgtaacatgttgtctctctctctacttcctgtaagacataaagatgtccacaatcacattgacagcagaaattgacctgattataaataaaacagtaagtaagtaattaggggaactttgattcccgttcatgatatcaatagcaaaaatatcttaaaacaatgatcaaaatctataaaggaatgctcttcccgagtgaaaaggcttcaaaaatgtttaatactatgttaagaatgtaaaacgtgtttcaatacacagccagatggtcttcagagaaagaggaagaaagtggtcatagggtctccatcccctttatcagctttcatagcccatgagtgatcacaaagtgatgagagaatcccagtgtccggaagcagattattttgtcttctgcttcccgagcccagggcaggggtgattcctaatgtccagaaatgcagagagagagtcctgatttggaagggggaagcggggaaagatcaaagcttggatgatacacaaaagaatctgagtagagggtatgaagatcagaaatacaatgagaggctgcgcgtggtggctcatgcctggaatcccagcactttgggaggcggaagtgggaggatttgcttgagcccaggaggtccagacttgaaaacagaactgggagtgtcagtgtgaaggaaaaaggcctagaggactctgcaggcactgagtgctgcatgaaggagagacgcattcgccttcattgctaggggtaggtgctgccgggagagggggcgaccattgcccacacttggaaatgttctgtccacagagggaaacgggcgacccccaaagcacagaggggcggcccctcagtctcgccgagaagtgagggagagcccagggtgtagagcaggaaaggaatgagatggaagataacaattagagttgcaggcagcaagaggtcaccttcagggtactgcagtggtctgaccccatgtggcttgtgcatgggactgaggacgaagctctgatttttctttttatcttgcccaaattcctatctaaggggtctggagagtcatgccctacaaaccaaaaattctcatcagaagggtttcatttaactatatattgtgacttactttccaatctgactctggcataacatgagaccaataagaaaatcaaaatattttacccaaaaacatgtttctttgccatatcttgaaatggccctgcaaagctgtcctttgtggggaaaaatttgcatctgtaaagatgtaaagaatctctattcacatagatattcacatctttttctaccggacccttccaatcctgaaaagattgactaagactctagcaccttttaaaagtctgaataggaaacaattgtcatctattgtctctaagggcagccgctacaagacttcaaaataaccttggtctccacaatcttttctcttaacctgaagatttcttttctagggatcccagggttttttttttttttttttaatctttcttttttatttttttgagacggagtcttgctctgttgcccaggctggagtgcaatggcgcgatcttggctcactgcaagctccgcctcccgggttcaagtgattctcctgcctcagcctcctaggatcccaggtctttagatgaactcaaccaattgtcaaccaggaaatgtttaaatctatgtataagctggaagccccctgactttgagttgttccacctttctggaccaaaccaatgtgtatcttaaatgtatttgattgacacctcatgcctccctaaaatgtataaaacaagctgcaccctgaccaccttgggcacacgttcttgggtcctcctgagggctgtgtcatgggccatggtcactcttatttggctcagaataaatctcttcaaatattctacagagttcgcttcttttcgttgacaggacatgggcatgcatagaagataaagagacaggagcatgcagatgtgttgggtttctgcctctgagtaaccaggggagtgacctggccacttttagaagggccgagcggccagtgagtgaggacacactggagccagcaggcactgagagcctagaagtggccgtggtgtctgtccaggtgaaacctgaccaaggatagacacagctggtgtgggagcggggagggcagagaggaggggtgggcaaggtccgcagggctgcgaaaccccagggtgtgagtgggagagaagcgattggttgagggatttcccctcaacgccttttcggggatgctgggaggggtgtttgctcctagcaggattcaggcacaaaaccagtcttctgagaaagacaatgagctttgtgaaaggaaaataaatctcaaggcccgcaagtcaataagctaaagggaaaagtcaagcggggaactgcttagggcctctgcctcccattctagtcaaagtcccccctttgctcactgagatagatgcgtatctgattgcctcctttggaaaggctcatcagaaactcaaaagaaggcaactgttcctctctcacctatctgtgacctggaagccccctccctgcttacagtcttcctgcctttgcttcaagttttccggcctttccagaccgaatcaatgcacttcttacattattgatggatgtctaacactgaattgctacatctccaataattttctgtctgtcgaagagaaaaagaccttagatatcatttgtgctttgtttagaacacagaaggaagggataaggtgtacgccgtgctcgtgaggtttttttgtttatttgttcgtttgttttaccctagagagcacacacaattctcatattctaaaagtaatagcaaaagacgcaattacgtttcaccaacctaatagcatcttcaccgggaaagagattgatttaaaattgtacatggagagaaaaccaaaatgagcattttaataccctcagcattgctttctgacctacaatgacatgctgccaatggtcagaaaacggaataaaagcaaaatactgtacaaatgtaatgagaaaaccccaaaccaccacaaactaggggaagatggtttttgcagcaatcctgcccagcagtggtttatctctgggtgtggagatttaggaaaagtgctctttttctaatttttcttttcttttcctttttttttttttttttttttttttgagatagggtctggctgtttcacccaggctggagagcaatggtgcgaccatagttcactgcagcctcaaattcttgggctcaagcgatcctcctacctcagcctcccaagtagctgaaactacaggcacatgccactatgcctggctattgatttttttttttttaagtagaggtggggtttcctcttttgctcaggctggtctcaaactcctgggctcaagcaatccacccgcctcgacctcccaaagtgctgggattacagacgtgagccaccgtgcccgacctaatttttctttctcccgcaatgttatgtatttataagtaaaaatatgaatattttttcttggagaaaaacgttaaataaataaagagatggtgataacagccttgaatgagtttaattttggaaactgtgacattgaggtgacccagagcatggggcctgcccaaggcctctcctgcagattagaaaacagatcccccttctccaggaaagagctgcattcctaggcctgtaagtcacgggtacgtttctgctttatcaaaacaaactgggcaattattcagagacagaaaagggaacggggagctctttgttcaccacgctattcatgcctggtcacggagcccaaatccagcacaaatgaacattcacaggactcacctctgctcctgggctccttcctgaatccccgatcaagaagaggaaggttctctcccaaaggaagcaagcgtgaaggcagagagcacttgcacaaggctttgagctgggaatgattaacttcgagtttgtttttcccaagtcagaagatcagagagagttaggacagacagagcagactccccccacatcgcagcatgggggaatctcaaagccacgcccacgtctaccaaaccagtggtcagtttccttaggtttttattttgttttattttttgtagagacggggttttgccatgtggcctaggctggtctcaaagtcctgagctccagtgatctgccctccttggcctcccgaagtgctgggattacagatgtgagtcaccgtattctgccagtgtccttaggtttttaagtgattgcctgtgctgttacacagggtgctggctataatatgatcatatccaacctggcatggtggctcatgcctgtaatcccagcgctttgggaggacgaggcaggaagattgcttgaggccaggagtttcagagcagcctgggcagcaaagtgagatgctgtctcttcaaaaataaaaaatattaggctgggcagtgtggcttatgcccataatcctagcacttggggaggttgaggcaggaagatcgcttgagcccaggacttcgagaccagcccgggcatcatagcaagaccctgtctctataaataataaaacaattagccaggcatggtggcatgtgtctctactgccagctactcaggaggctgaggtggaaagattgtttgagcctgggaggttgaagctgcagtttcactccagcctgagtgacagagcaagaccctgcctcaaaaaaaaatgttttaaagaagttatttgttgagtggtaaatgaagtaaataagaaataataaagataagataaaaataaaaaagaaaacatttcttaaagtaaataaacaaacaaacaaaagaagtaaaaaggccaggcgcagtggctcatgcctgtaattccagcactttgggaggacgaggtgggccgatcacttgaacccaagagctcgagactagcctggccaacatggtgaaaccctgtctctgctaaaaatagaaaaattagccaggcatggtgtcacatgcctgtaatcccagctactcgggaggctgaggcaagaaaattgcttgaaccccggagtcggaggttacagtgaggcaagatcgcagcattgtactccagcctcagcaacggagagagactctgtctcaaaaattatagtaataataataataaacataagataaaaagaaaaaaaataagcaaaaaaaaaagtaaaaaaaggattattttcaagcaatgcttggtttaaaaacatagaaaagacgggctgggcacggtggctcacgcctgtaatcccagcgctttgggaggctgaggtgggctgatcacctgaggtcaggtgtttgagactagcctggccaacatggcaaaaccccgtctgtactaaaaatacaaaaattagctggatgtggtggcgtgcacctgtaatcccagctacttgggaggctgagataggagaatcgcttgaacccgggagacggagcttgcagtgagccgagactgtgccgctgcactccagcctgggcggcagagtgagactccgtctcaaaaaagaaaagacaagacaagaccaagagggcaggaagcagtttctgaggcactgcatgatcattgctgggaagttactctgtagaatggaaccctacgcaatggtccctattattcaaccatccttgacctacaaggacggggtttcatagagttccacctgctgtctcttcgcaacttcatatgcagccacatgctgggtctgtgagaagtcacatagcctacctgatctcacttcctccttatgtgggggtggaaaccaccctacttctgggatgaggagctgacacgctggcacactccagcctgactcatttttacaagtggacggttttggtggcatgtctcaaaacgagtattaggaggggtgtcagaaatgttttcttttcctgccacaggtgtgtgccctaatggtaattgctttcactttgtgatttttggcaacaaatcttaagtcatttcctcgtagggggcctaaaggaatattttcacctatattttaatttatatattcataattattatatataatatagtataacttttgtacatcatacatagtataaatgtatcacataaaatatgtaaataaggctgggtgtggtggctcacgcctataatcccagcacttagggaggccgaggtgggaggattgcttgagcccaggagttcaagttaagtctgagcaacaaagtgagagcctatctctagaaaaaaaaaacaaaacaataaaatatataaatataatatataaatatataataaagcataatttttctttattaaaatatgcatgcttttctttacaaaaataatatatactttaaaatatatatgtacatatatgtatagatacataaaacatgtacatatacgtacacatctacatataaatacatgttataatatgcacgtataaatataaacatataacatataaacatgtacctatagacatctacatacatgtttatgtgttcatatatgtatgcttatatgtatataatgtatacatgtacatgcatgtatatatacatacatatatgtatacataacatatatacctataaaacatgtacgtatatacatgtaacgttaatatatgtactttttaaagtaaaaatgtttatgtgtgtatgtatagtacatatatacatataaaacaagtacatatatgcatataacatatatatgtacatgatttttcaaggaaaaagcatattatgggctgcttctgacttgcctggggaacatgactggttgtgtttgttttatcgggctggttatattggtgtctaaatataggaccctcaaacatgtttgaacagtcatatgacgtacggttagatatcaagtctgtggcctacctctgaactgatgtatttatgtatttagtgacacaataaaagcagatttttcttttccaaagaactctgcactttaacccttggaatgttaaacattttggtccagatttaatttttactactgaataaaactttctacttttttattctaaagacacaaggtatctttagaaagagacaagaggctgggcgcggtggctcacacttgtaatcccagctggcacactctggcctttgggaggccgagatgggaagatcacttgaggccaggagtttgagaccagcctggacaacacggcaagatcctgtctgaatttaaaataaaacaaaataataaaatatagaatacagtaaaatataatacaatgcaatagaaataaagataaaagaagcagacgaggaaacacccatgcaagactgacaatatagcctttgattctcttccggggagaaggaatcccagccctcctttcccgccctgagcttcagccccgggctgcgagcctgtgttcaacgcttcgcctgggccctgttcccaaacccagtttcgcttttcacctccggtgtctcttcgatgttcagtgcacgtgccttcagcatctctaagataagaatctagtgtggatgcaatgtctcccatttggtgcatcttccctcgttgctttttttttacgcattacgtttggaaatctcccatgtaaaatctgtacttgagattttcactgatgattattattattttttgaaagcaaattacttttaaaacattgacagggacttgtttgaaaagacgcagtttagcataaaagaatatcccctggagcgtctctgcacgtgcaaaagccggcctgtaagaagaagccccaggaaggccagttacctgacatgcagctgtgtaagggcgacactggctggatgtagcggggaggctgctccttggaagaaacgtcttcttcctgccaaaacagacacgcactggctgtctcggcggcactgaacggctggctcacgcatgtgcgtagctgattcactctgaaaagcaaaaacaggaattccgcagaaaccaagttaggttgtcccagaaacagatcaggcaagtccccaaggaatgtactgctgggtctttcaggcgtccacaaaagaccttctgttctatttgcagaacctcactctcgcggaaggagcccagacatctggtgctgaacgcggggtttttcaatggcaggaaggtggaatcccttcgggcttttgatgtaggcagagtgcatttcccaaagtggaaaagtggttttcttaaaactcatcttgaatcatcactccgtagcccttcaatttcacgcctttttctttccttttgctatttgcctcaaacataaaaagaagacaggaaacaattcaggttacagttgcaactatgactgtgtgtacacagccgcaactattaccatatgtatatagctgctcacctatgtgactctgtcactatcacttccgtttagctctgtgcaccaatgtgttttctcatctatttgccagggagcgcatttcttttttcatattgaagcagagcatacattgcaggcaacgttaggtgtaaaacgaatcacttcaaggactttttttttttttcaaataagagctgtctgcacacttctacgtgttgaatcacaaaaatattcatcctaatgcatttatagtctctatagcctgaacattgcagagttttgatttgagactcccgcttgccaaataagccctcttataaatctgcagctgcctacattcttcatgagtttaacacatcagaaagaacaaagcataggctcgacgggctgaggaacacctaccgctctaggccaagtctactaggttatgttgctcttgagggaaggctgtcaacactcatgcagttattttttgcacaagttgaacatcaaggagataaaaccgggatccaaattggaactcccaggttggctgaacttcagcctgactttctatgttctgggatgaggcatggttacgccactaccctactattgacctctgaggaggatgattctttattgtaggggccgtcctgtacattgtacaatgttgaaaagaatccctgggctccactccctagaagcaggtagtgatcaccacctcctccccagttgtgacaaccggaaatatctccagccgtggcacaatgtctcccgggggggcagaatcactccggttgaaaacactggtgttaaggacgtactttgcaggtgactggagaacacttaattacgatcatgctgggtgagccatttcaatttgtttctcatactcccacgtccttcagagctggtagcagaatcaagctccacacctgaaactcttagcacgaacgttatacaacagtacttgtcagctgcatttccaatactagcatcccaaaagagatactctcttagcatcaagtaaagtcatttactctttttttgttttttgttttttttttgagacaggggttcgctctgttacccagactgcagtgcagtggcacaatcactgtcactgcagcctcgacctcctgactcaaatgatcctcccacctcagccccctgaatagctgggaccacaagcacacgccaccacaggtggatcgctttttttttttttgtaaaaatggggtcttgctatgttgccccctctaatcgctaactcctggcctcaagcaatcctcctgcttcagcctcccagaatgctgggattacaggtatgagccactgtgcccatcctaacaatacatattctttagcaaagttcagatccccaccgtcatcctaaccttgtcttctgcacggagctttcgtctctgaacaaggcggacgttcgctttcccttgactccaagttgaactacgaactaaagtggtctcattgtcatcttgggcaccatatgctagaagaagcaagacaaatacaagacaacaacaacaacaagaacaacaacaatgtagcctgtgaggttagaagcaacatggaatcagtcatgttcgatttctctcattatttataattctgtaaaggtggtttcatccatctttcccaaacaaccacttcatattccactctagctggaatttatttatcctgggctatggtttaaagtgtcactgtaaagggtgacataaggagccactccttttgggcagaattccttctctacctcaaattccttctctacctggccaccattttccatattccttgcacaggtaatacttgaaaatattcagacataacttaacattttcatatgggttgcatacaagaagacaatctggaaatccatgtttctaaactagttgcttcagctttgacattatgaagaaaaagaaacgcccatgggggtaaaatggatggtttgtccacatgagaaaatgtcttatatacggtgatgtatttttaagaaaatctatgaaaagctatttttatctcaactatcatcatctactttgaacagaacctgacttaacaaaaagttaggtgggtgcagtggctcgtgcctgtaatcccagaactttgggaggctgatgtgagaagattgcttgagcctaggagttcgaaaccagccttggaacatagtgagacctggtctctaataatttttttttttaataaaaatgttgctgttactattgtgtctcataagtatcaaatcttttctaatctctttggactcctaatccctcacccattctgaagatgtgcatgtcagcatgcatctaattttaaatagcaaaacatttcttatgttgcacttatattgcatgtcataaatcaagagaagtcggtgaagagctacaaaaataccattggatagaagggataagttctagtatttgatagtacagtagggaaattatagtgaacaatgatttgtccagcctatgaccctgtctcaaaagttaaaatgaaaacaaaacaaaataatgatttgttttatgtttcaaaacagctagaaaagaattgtaatgctccaaacaccaagaaagtatgaatgtttgatgtgatggataccccaaattccctgattggatcatgacacattgtttgaatgtttcaaaagattacctataccccccaaatatgtacacagccaggcatggtggtgcacacctgtagtcccagctacccatgaggccgaggcaggaggatcgcttaagactaaaaggtcgaggccacagtgagctgtgattgtgccactgcactttagcctggacaaaagagtgaggccctttctcatgaaaaaaatgtacaatgatgatatattaattttaaaaaatgagatgagatttttcccttgacccccttcatgggccggaactggagtggctcatttcactcagcctgcagtccatggatgactaagtgttaacagcccagcaaagggtcagagtgacagccttctgcacctgccctttttgacacccgagttcttgtttggcatccaggtggtcacagaaatggattgaagggtagtgtatgcggaggattttactgggcgatggatgtggctctcagatggatgtgctctcagcagaatggggagttggaaaggggacggcgtgggaagaaggtgatctttccctgaagcccagccatctctgactgggctcccatctgaagctgcaccatctgaagttagcttctatttgtagtctcccttgctcagccacttgtatacccgacgctcagcagcttgcatccctgactgcttgcatcagctgcttgtgttgctctgccagcagaagtctggtttttatgggcacaggacagggggcagggcaggccaaaagggcaatcatttgggttgaaatatgggttcagctgttttcacttaggactaaggttccaggcttgggggtgaagtttagccaggagcccagttgttctgtaccattttccccctctggagaggcacatctaactgcccttagaaaatggatgacgaccagtctgagctacttcctgctgaaagagggcgttgtttggggaaaatggcagttagattcctcccagaggtctcccaagagtccccggcaaaggcgagccatcatccgaggctccggctgcctgcccatttggagccttgatggcctctaggtgaaagaataaacaagctttacaaggttaagtaggcatggatcaaacatgtgtattatacaaagaaagaatgtagtgcaaaacatctcagaaacaagaaataaaacaacactgtaccccaagctgcctcaccctggtgaaagaaattaaacctcgtatgggagcagttaaactttatgagccagagaagtgctctcgccacatctgtcggagttaacaggtgaatcttaggaattctgaggcttatgggcttgccggcgggcagtaaagtttctgcctctttcttgtgtctaaaagaccaaggtggtcgttttcaggatgtcctctaaagtactatctggtcccagggtctgtttctgagtataaactggaggtggaaaattgtgttggttgcccattctgaagacagggaattaggcttccctcaattctctttctcctttcagtgataacctggggtatgagggagagaggaagtgggcatcctcctttcctcttctatcttttcatccccaagtcccagcaaccttgacaggtgccacccatgggtgccaatgtggcttgcacccatgaagccgggggagcctagagaataggaatgattcacactcacctatgcctctacctcccctgctgttgacaacctttgagttccttggcaggtgccacccatggctatcaatgcagcttccacctgtgaagcagggaagacccagagaatgggaattatctgcactcacctatgcctctacctcccctaccatcaacaacctttgagtttcctgggcctcatttatgccatggagtatggcctccttccgtaaagcaggggtttaatggacaggaatttgtcctgcctatttacactgtgcctgttgcctggctcagatctggttttcctttctagtgcctcgacctgcagcttggaatcgagtttgagaccaaaaaaaaaaaaaaaaaaaaagtatttcaggggctgcatagatttatttagattaagtcccaaacaggccttgccaaatttacagctaacagcctgcagacaatgcccctctgtcgtttccccatcataagcagagtgctgacgtagacagagaactctcttacttggaaaagaagaaaaacaacttaaagtgcatggtggcgggggaagctggggaaagagcctcttgctctgtggaaatgggttcctttaaccactgcatccctcccccggttcagaccagctagactttcatgaagggaaacagagccaacattcctttttcctgaagaaaagagagaggaagcagggtctcagaaaagagacagatccaacaattccgcattttaacccaccctttgttgtatcccagacgagcctccagatgagataggattgttcccttgaccccctttgtgggcaggaactggagtggcttgtttcactcagcctgccattcctggacagctaagtgttaatagcccagtgaagggtcagggtgacagcctcctgcacctgcccttcttgacacctgcattctttttcagcatccaggaaaaatctggtcacacgagcagattgaaaggtagtgtatgtggaagattttattggcaatggatgtggctgccagcggaatagggggttggaaaggggatggtgtgggaagatggttagctttccctgaagtccagctgtctctggccgggctgttctcagaagctgcactgtctgaagttagccatgtctatctgtagtctccaatgctcagccacttgtatcccagccttcagcagcttgtatccccaaccacttgtgttgctctgccagctgaagtctggtttttatggacacaggatagcaggtggggcaggccaaaatggcaactatttgggtggaaaaacgagatcagctgttttcacttaggtccgaggttccaggcttgagggtggagtttagccaggggcccagccattctgtaccaaatagacatgaaatgaagtagaaaaaggttaaacaaactgagagagagagaaaagtgcccaaactctatgagtggcaacttcaagaaatcaagtaaagggtcccattaggacaataaggaaggaacctacaaatcagcatgactaaatgctgcttctaaggtccaacactgaatttatacccgctcgggtccacaaagaatagaagaggagacataaatggtaagataaaaggtgaaatcttcttccttggtctgtgctttttatctcatctctagcctatcccgtctttattttatctttatcaaagtggggcatctcctaaggcatgtttgtgagaaacaagaaagaaaaaactctcgtggagagagttagtataatcccagcactttgggaggctgaggtgggagggttgcttaagtccaggagttggagaccagcctggacaacatggcaaaacctggtctctactaaaaatacaaaaattagccaggtgtggtggctcacacctgtaatcccagctatgcaggaggctgagacaggagaatctcagagcctgggagtctgatgctgcagtgagacaagattgtgccactgcactccagcctgggtgagagaatgagatactgtcaaaaaaaaaaaaaaaaaaaaaagaaagaaagaaagaaaaaaagaaaaacatccaaaaaacctgtgagtcagaatttctacaggttggctctgtaccagaattgcctcagacagtttttcacattgtgggtttcaatcctcctttccagcttgtctgaaccatggcatttaggtttggactccatgcagtattgtttttttaaaaatctgtctagttgaatgtgcccaaccacaactgtgaatgcgtcacagcattcagctctaatttagctttttcttgctaaatatgtataaatatatgtataattctgcaaaagagcacttttctcagaattatacacatatttatacatatgcaaatgcacacacatatacatatacaaacatatatacatatactatacacacatgcataaatatatacacatttgcacacaaacatttataaagatacacttatatataccatacacacatatacacatacatatatacacatgcacacacacatacgtatgcatccacacatatacacatgtatacatacacacgctgtacacttatacatatgtatagacatgcacccacatacacatatatgcatgcatataccatacacatatgcataaatatttacacattcatacacacatagatatacacatatttatatgtgatacacacatgtatacacatagatatacatatacatataaacaccatatgtatacatacacacatccacatactatgcacatatacacatatacacatcatatatgtacatttacacatttacataccagacatatacacatatatgcatatatacacacataatgcacatatatgcatatacatatatgtacacatatatacctgtatacatacaccatacatatacccatactaatttatatgtatattttaaaatttttttgtagaaatggggtcttgatatggtgccaaggctgttcttgaactcctgtccttaaatgatcctcttgcctaggccttccaaagtgctgggattacaggtgtcagccactgcactcagtccccttactcatatataatgcacatgctatacacatacgcaaaaacatacacattcacacaagcacatagatatacacatatctgtcatacacatatatacacacatatctgccatacgcatatatacacacatatatgccatacacatatatacacacatatatgccatacacatatatacacacctatgcatataaatatacatacacacatatacatacatcatgcatacacacatatacatatataaaaacctataccatacacatatatctaaacatgtacctattaagaggcacacacatacatatatgcacatacaagtaccatatacatacatataaacatatatatactatacacacatagacacatgcatatatatgcgtatatatacaagtaacacacatgtacatatgtacacacaccatacacatatacatatacacatgcactcacatatatgtatgtgcatgcatatacatatacacataatgaatgtatatgcacatatcacacacatatacctatacatacatgcacgtatacatatacatgcatgtatatataccatatacataaatatacacacatgcatattgacatacacatagacatgtacatatacacatatgcatatatatacacatataaacacatattcttcagtaggcttgagaaatgcagttagagagacttaatttagctagcagcactggacggcctccaaaaaatatttagagttgcctggagtcttatttttaatttagtttttgtttaaaagcaatcaactttattgatcaatacttcacatacaataaaagtatcagttttaagcacacagttcaataagtttcaactaatgtatacacccaagtcactaccgccacaaatgaggtgtagaacatttttgtcaccccaaaatgttccttcatgctccttggcagttaaaactctttcaccccatctcccaatccctcactttctggcagctgctgatcattttttcatcattacagattacagttgacccttgaacaacaggtctgaactgcatgtgcccacttatacaagaattttcttccactctgccatccctgagacagcaagaccaagccctccttttcctcctcctcagcctcctcaacttgaagacaaggatgaaaacctttatgatgatctacttccacttagtgaacagtaaatatattttctcttccttatgatttccttccttcttccttcctctttcttttctttcgttctttctttctttcttttctccttctttcttttctttcttttttttttttgaaggtcttgctctgtcatccaggctggagtgcagtggtgcaatcatggctcactgcatcctcaacctcctggactcaagcaatcctctcacctcaacctccagagtaggtgggactacaggcacatgccactatgcctggctaatttttctattttttgtagagacagggtctcactgtgttgcccaggctggtctcaacttcctggcctcaaacaatcctcccaccctggcctcccaaagtgttgggatgacaggcgcgagccactgaccccggccatgattttcttcatagcattttttccctctagctactctactgtaagaatacagtatataatacacagagcatacaaaatatgcggtatattggctgtttatgctgttagtgaggcttctggtcaactgcaggctattagacgttaagttatgggggagtcaaaagctatgtgctgactacacccctaacccctgagtttttaagggtcaactgtaggtatacctgtcctagaagttcacatacatggagtcacattaagtatataaaatatttattttacgtctggcttctttcggtcaccaaactatttttaggattcattcatcctgttgcatgccttatcagtgtgttcctttttatagctaagtactagcagattctatagatatcaatccatccgttcttccccaactgatagaaacttgtattgtttccagtttgggggcaattataaataacactgctataaacattttttgtgtgtatggacacattttccaattctcttggataagtacctaagagtgaagtttttgagtcacatggagagttgtatgtttaacttttttgtttttgttttttggagacaggtcgtctcactctgtcacccaggctaaagtgcagtggtgtgatctcggctcactgcaacttccgcctcttgggtgcaagtgattctcatgactcagcctcccgagtagctgagattacaggcgtgcaccaccacacccggctaattttttgtgtttttagtagagatagggtttcaccatgttggccaggctggtctcaaactcctggcttcaagtgatccttctgcctcagcctcccaaagtgctgagaccacaggtgtgatccaccacgtctggcctattcaacagctgggcatggtggctcatgcctgtaatcccaggaatttgggaggctgaggcaggcagatcacttgaggtcaggagttcaagagcagcctgggcaacgtagtgagaccacgtctctactaaaagtacaaaaattagctgggcatggtggtgcacgcctgtaattccagctacttgggaggctgaggcatgagaaacactggaacccaggaggtggaggctgcagttgagctgagatcatgccactgaactccagcctgggcaacagaggaagactctgtttcaaaataaataaataaataaataaataaataaataaataaataactgagctgttcattttcttattattgaattgtaagaattctttatatagtccagaaatcagatgtatgtttggcacaaatatgaacggataatatattgtaacaatttgttgctttccttttcatttccttaacactattgttcaacgagcaggagtttttaatttcaatgaagttcaatataccatttaaaaaaaatagtgtgtgcttttgatgtccttttaggtaatctttgcctgcccctaaggctgaaactcctaagttttcttctaaaaattgtaaagatttacgtttacagttaggtctgtaatacattttgagtgttttgtttttttttttaatagcatgagagaaaggtcaaatttcacatcagttgttctggcactttatttgtttggaaaaccattttctgcctttttgcttaccttggcgacaatgtggaaaaattcataaatgagcgtgtcattcttgaattctcctttctgctccattgacccgtaactatgctaatccgagaccatacttgtttggaatcttttccccccttcttttcacatgtgtttatggaatcttacattttctttcttatatttttctttcttcttttgagacagagttttgctctgtcacccaggctggagtgcagtgccacaatcttggctcactgcaacctccacctcccaggttcaagcaattctcctgcctcaacctcccgagtagctgggactacaggtgcacaccaccacgtccagctttgagtacagaaagtggtggtggctacataaccctgtgaatgtgtttaatgccactgatttgtaaacctcagtgttccttcagaataaattgatcatgaatttattccttcagaataaattgatcatgaatttattccttcagaataaattgacattgatcatggtcaacatgataaatattaagctatgtatattttaccacaataaagaaaatccaaccaaaacaaaaaacggtccagaaaagactgaaggatgctaaagagacataactaaatgtaacataggatctttgattagattctggacctttcaaggacatttttgaggacatcaatgaaacttgaatgaagtctgtggattagacagtaattttgggtgatcatttttttgttttctttttagtttttgtagagatggtgtctcactctgttacccaggctggtctcaaactcctgggcttaagtgatctacttgcctcagcctcccaaagtgctgggattacagatgtcagccactgtgcctggcctgggagactgttaatttgttggttttggtgagtgttctgtgtttatgtacattgaatatcctaatctgtagtttatagggtttggctgtgtccccacccaaatctcaccttgaattgtaataatccccacatgtgaagggtggggccaggtggagataattgaatcatgggggtggtttcccccatactgttcttgtggtagtgaataaatctcgtgagatctgatggttttataaatgggaattcccctgcacaagctctgctgcctgccaccatgtaagatgtgactttcttcctcattcaccatccaccatgattgtgaagcctccccagccatgtggaactgtgagtccattaaatctctttcctttattaattacccagtcttgggtatgtctttatcagaggcatgacaactgattaatacagtaaattggtaccagatagtgggacacttctgtaaagatacccaaaaatgtggaagcaactttggaactggataacaggcagaagttggaacagtttggagggcccagaagaagacagcagaatgtgggaaagtttggaacttcctagagacgtgttgaatggctttgaccaaaattctgatagtgataagaacaatgaagtccaggctgacatggtctcagaaggagatgggaaatggtttgggaactggaataaaggtgactcttgctatgttttagtaaagaaactggtagcattttgtccagaaatctgtggaactttgaacttgagagatgtgatttagagtatctggtagaagaaatttctaagcggcaaagcattgaaggggaagcacagcataaaaatttgtaaaatttgcaacccaacaagaaaagaaagctccattttctggggagaaattcaagctggctgcagaaatttgcataagtaatgagcagccagatgttaatcaccaagacaataaggaaaatgtctccaggacatttcagagactttcacagcagcccctcccatcacaggccctgaggcctaggaggaaaaagtggtttccagggccaggtccagggcacccctgctgtgtgcagccttggaacttggtgcccttcgtcccagcccctccagccatggctaaaagggaccaaggtacagctcaggccattgcttcagagggtggaagccccaagccttggcaggttccatgtggtattgaacctgcaggtgcacagaagtcaagaattgaggtttgggaacctctgcctagattttagaagatgtatggaaatgcctggatgtccaggcagaagtttgctgcaggggcagggccctcatagagaacctttgctagggcagtgtggaagggaaatgtgtgtttggagcccccacacagagtccacactggagcactgtctagtgtagctgtgagaaggggtccgccatcctccaggcccaagaatggtagattcaccgactgcttgcactatgtgcctggaaaagccacagacgttcaattccagcctatgaaagccactgggagggaggctgtaccctgcaaagccacaggagtggagctgcctaagaccatgggaacccccctctcgcatcagtgcaccctggatgtgagacatggagtcaaaggagatcattttggagctttcagatttgaccacccctctggattacaaatatgcatgggggctgtagccccttcatttcggccaatttctcccatttggaatgggtgtatttacccaatgcctgtatcctcaatgtatctgggaagtaactaacttgcttttgattttacaggctcataggtggaagggacttgccttgtctcagatgagactttggactgtgaacttttgagttaatgctgaaatgagttaagactttgggggactgttgggaaggcacgatgggttttgaaatgtgaggatgtgagatttgggaggtgtcagaggaggaatgatatggtttggctgtgtccccacccaaatctcattctgaattttaataattcccatgtgtcaaggatgaggccatgtggagataactgaatcatggaggcagtatgtcctatactgttctcatggtagtgaataagtctcatgagatctgatggttttattcaggggagttctgctgcacaagccctctttcatgacaccatgtaagatgtgactttcctcctcattcaccttccaccatgtctgtgaggcctcaccagccatgtggaactgtgagtccactaaacctctttcctttagaaattctcaggtgtgtctttattagcagcatgagaacagactaatacagtagtaaatacaccctgaacaattacactataataggacatcttcttttcaagttattctcaaagggcttagaaatgttagcaatcggggaaaatctatgtaaagtgcatatgggaggcctgggtactgttcttttcccacttttattcaaatttgaacttatagtatgacaattttttaaaataaatgtattctggttcaaagtgcccagtatgatcagtcgtagtccatagtgaacagctttcatcacgcttccccaaatattttgaaaacccctttcaggctagacacagtggctcatgcctgtaatctcagcactttgggaggttgaggcaagaggatcacttgagcctgggagttcaggaccagcctgggcaacatagtaagacccccaactctatgaaaaggaaaaaatattttaaaggggaaaagaaaactccttttgtaatttgatagtttcctatctgggctttattctagaccgactgaatttggcattctgcaggaaatgttccagaaaccttcagtcctgagaagcctctcagttaattctgatgaaaattaaattttgagaacccctggccaggcataaagtgtggatcccatgagtaaggtatgtggagatgaaaactaagaagtggtcttgtcacacaagaatacaatctttaattcacatcatcaatgctgtattttcttttgtttcctttattattattattattagagacagggtctcattctgtcacccaggctggaatgcagtggcacgatcatagctcactgcagtctcgacctctctgggtgcaggtgatcctcccatctcagcctcaatgttgtatttgagagctgatttttacagtgagcttaacattttgaagtgtagtgctctgattaattagaaacacagattttcagaccttatcttcactttttaatttttttgagacaggatcttgctctattgcccaggctggagtgcagtggtacaatcatggctcactgcagcctcaacctcctgggctccagtgatcctcccacctcagcctcctgagcagctggaactacaggcatgcatcaccatgcctggctaattttgtgtgtgtgtatttttgccagagaggcagtttcattatgttgtccaggctggtctcaaactgctgtcaagcgatctgcctgccttggcctccaaaagtgttgggatcacaggcgtgagccactgcacccagcttggagtgcattctctcccagttcggcagggccacattccctctggagactctaggggactaggcttccttgcctatttcagcttctggtgcttgccggcaatacttggcattccttggtgtgtagacgcatcactgcaatcaccctttccattttctcataagtggtttccctctgtgcatgcctgtgttcctccttttctttttccttatttgtttatttatattgaagctatgcatgaatgtttctctccttcctagaaggacaccagtcattgcctttagggcccaccctactgcagtaccccttcagctcaagagcctattcccaaatgaaatcacactcacgtatacatgagggttaggactttaatgtgtcttttgtcgggggacacacttcaacccacaccagatggataaagcagaggctttgtgtaggtagaagcagaaatgatgcaattcccattttaggggatgggttcctgtaaatcctgcctgctcagaagggcaaatgtagaaccaacagcagccatggtgacacctggtagacgcggaggccttttggctatcaaccagacctatatgcaagcagtttagttgtccctaaaagactcccccagtttaacgaggaggcatttggaagcaggagaggagagaacttaggcgtgtcttatcaataggattccactgcacccacaaactggtgaagcaaggagagaaagctacagatggaaattacttatactatgatgcagtggtaaacatttgactcaacttagcagaacaaaacccaaatggaaataatgatggtggacacagtgaggtgctcctgtgtaacactgatgcttcttggccagcactgtcctgatcttgccaggagatgccagcagagtgaggttgcgctgccccttggctgggagggagtgcaagacgcatctcaaattcagaagcgttgacaccgggagctctgtggttattttcttccatgctgtggattatcttcactcttttgatagtgtcctttgatgcaaaggattttcaatattggtgaagtccaattactctgtattttttcttttattgcttatacttttggtgtcacattgagaaactattaccaaatctaagacctatctatctggatatctatctggaaagccctttccagagaaacagaaccaataggaaggatagatagatagatagatagataacagatggatagatatatggagggatagatagagtgatagctagatggagggtggatagatggatggatagattgatagatacatagatagatggatataagagagatagatagagtgatagattttggtaaagtctaattactctattttttttttttttgtactggaaggaccagtacattaatataagtcatgacttttggggtatttttttgtggtattttttagagaccagccttgctctgttatcccagctggggtgcagtggagtggttataggtcactgcagccttcacctcctggtctcaagggattctcctgcctcagtctcctgagtagctgggaccaccatgcccaacaaattttttttttttgagacagggtctggctctgtcgcccaggctggagtgcaatggtgtgaggctcactgccacctccgcctcccaggttcaagcgattcttctgcctcagcctcccaagtagctgaaattacccgcacatgccaccacacctggctaatttttgtatttttaggagagacgaggtttcgccttgttggccaggctgctcttgaactcgtgacctcaggtgatccacctgcctcggcttcccaaagtgctgggattacaggcgtgagccaccacacccagcctgtgtttgtttttttgtagagatgggggtctcagtatgtggccacggctggtcttgagctcctggcccaaagtgatcctcccacttcagcctcccaaagtgctgggatgacagatgtgagccactacgaccagacctcattctggtatcattctttgcctcacttcctccagtatgggatcccaaactgcagaggctatggagttagagtgacgatggcagaacttagagaatcagtgcccagctagggcgcttcccagctgtgtgacctcggataggttactcaatctctctgttgttgttgttgttgttgttcttcttcttcttcttttcttctcctccttctccttcttttcaaatttaagaacttctctgtctctctgttcttcttcttcttcttctttttttttttaatgttttgagatagggtcttggtttgttacccaggctgcagtgcagtggtgctatctcagctcactataaccaccccctcccaggttcaagcaattctcctgcctcagcctcctgagtagctgggattacagtcgtctgccatcacacccagataaattttgtatttttagtagagacagggtttcaccatgttggccagactggtctcaaactcctgatctcatgtgatccacccaccttgacctcccaaagtgctaggattacaggtgtgccgtcaacctctctgtttctcgatttcctcctgggcaggatggtattggagtgcccactggtgagatcactgtggggactacacctaacaccctttgaataaggtgagcgggacacacagaaacactgaggactgatggttattcttggtagctcatgatccagcccctccctgtcactccgtacgtactccctggattgagtgtctcacaacaaagacattttctgccgcactgaaatcagatcatggtgtgttttgcctttgagtcattttggactccaaggtaacatgtaagtgtgtgtctatgtaactttccagaaattctttctagaataagctctgctttggactctattttccccctcagggcttccactggatcttccagtccaggaatgtatctgaccttcccaatacattgatgggctttagtactttattttactattttatattttatgtttttttttaaattttattattattatactttaagttttagggtacatatgcagaacgtgcaggtttgttacatatgtatacatgtgccatgttggtgtgctgcacccattaactcgtcatttagcattaggtatatctcctaatgctatccctcccccctccccctaccccaccacaggccccggtgtgtgatgttccccttcctgtgtccatgtgttctcattgttcaattcccacctatgagtgagaacatgtggtgtttggttttttgtccttgggatagtttgctgagaatgatggtttccagtttcatccatgtccctaaggacaatgtcacagtaacctacatgtccactgaaggcctggaagtagtcatctatcttggtccttcatggatttttttgtttgtttgtttttatttccttcaactatttatttatttatttatttttgagacggagtctcactctgtcgcccaggctggagcgcagtggtgcgatcttggctcactgcaaccttcgcctcccaggttcaagcaattctcctgcctcagcctcctgagttgctgggattacaggcaactgccaccacacctggctaatttttttgtatttttagcagagatgggatattgccatgttgaccaacctactctcgaactcctgacctcaagtaatccacccacctctgcctcccaaattgctgggattacaggcatgaggcacggcactcggcctccttcaacgtttattttcagttctggggtacatgtgcaggatgtgcaggtttgttacataggtaaacgtgtgccatggtgatttactgcacggatcattccatcagccaggtattaagcctagtatccattaggtattcttcctgatgctctccatcctcccatccccacttccaacaggccctagtgtgtgttgttccccctgacttgttcattgttctcatccatcagctcccacttacaagtgagaacacgtggtctttggttttctgttcctgcattactttcctaaggataatggcttccaacttcattcatgtccctgcaaagacatgatttcgttcctttttatggctgcatagtattccatggtgtatatgtaccacattttctttatccaatctatcattgatgacatgtaggttgattccatgtctttgctattgtgaatagtgctgcaatgaacatatgtgggtgtgtatgtttataataaaatgatttatattcctttaggtatatacccagtaatgagattgcttggtcaaatgttatttctgccttgaggtttttgaggaattgccacactgccttccacaatggttgaactaatttacacacctatcaacagtgtagaagtgttactttttcttcacaacctcatcgacacctgttgatttctgtctttttaatatgagtcattctgattgacatgagatggccctttgttttgtttgtttgttgcttttgtttctgtagatacagggtctcagtatgttgccctatctttcacagagacagactggtcttgaactcttgggcacaagtgatcctcctgcctgtttctcaaggtgttggaattacaggcaagagccaccatgcctggcctccactctggctcttttgtcttgaagaaagagtaaatatttctggcttcctctaaagctggaatcagctctttaactgaactagaatactcatataggcacttttcactaaaattatttattgtaagaaataagaaaactagttgaattcctctaagctcctatttatggtctaaaatgtcattgagaatattgttatgttgttgggaatataatcattaaggattattcttggctgggtgcagtggctcacacctgtaatcccagcactttgggaggccaaggtgggcggatcacctgaggttgggagttcgagaccagcctcgccaacatggggaaaccccgtctcaaaaaaaaaaaaaaaattagccaggcgtggtggcacatgcctgtagtcccagctacttgggaggctaaggcaggagaatcgcttgaacctgggaggcagaggttgcagtgagccgagattgctccattgcactccagcctgggcaacaagagcaaaactccatctcaaaaaaaaaaaaaaaaaaaagaattattcttatgtctgcagtctgcatagtttgcatgttatttattgaaaaggcaaatgcaagtatatataagtctaacagtgtcctaaaaagatgctcatttttttgtaacttttaactggagttatttttcactaaatttctcatatatgcatcttgtcgtactactcttacccaaaacaaccccactctcccccaaccacagttaccacacacataataagactttaaccaggctgggtgcagtggctcacacctgtaatcccagcacttttggaggccgaggcgggtggatcacgaggtcagaagattgagaccagcttggctaacatggtgaaaccctctctctactaaaaatacaaaaaattagccgggcttggtggcacacacctgtagttccagctacttgggaggctgaggcaggagaattgcttgaacccgagaggcggaggttgcagtgagctgagatcatgccactgcactccagcctgggcgacagagtgagactccgtctcaaaaaaaaaaaaaaaaaaaaaaaaaagactttaatcaatggtgaaaacaaatgagaatgtcttgtgagaaaagtgcttcatgaggaatgtctaagctaatctcgcatgaagcacgtctcgatacttccacatataaatgcaggtaataacgttcacccacctcagaggagagtgttgaggttgaggctttatgatgcactgcttgtaagatgcatttagacccaaaggtggaagctgtactgtaaagtctgcagtcatatttcaaatgctgaaattcaccctgttagaattctcttccctcttcacttccttttaagcccaactgtagctcttggttaacttttctaaaaaaaattatcttcatggaaagcatattcaattttatagaattcccttcattccatatgtatgagtgtcagttgaaaggctgagataaattattcctttcttaaataactatgtaatagctgtcatggtaggttatgtttaatataaaaataattggtagactagagcagtgtccagcctcggcacttaatagatatttaattataataatgacaagagcaactaaggactacggcaggatcttggaattgtagaatcagtgtctgcaaatgcaggagctggggaatcaacttattgtaagtaaggaaaatacgttaagtttcctgtaattgcagttgggcatacttaaaattttaggtaaacaatggggttgagagtgaagagttgagtagttgttttatctagttttttttgttttttgtttttaacatgtttccaggtttttatctaaatgggctaatacagtacatactgttctgtgtggcttctcatgacatccatgaatattttgcctatatcaatagttgattcctagttattttcgagttgacttctattggattctggctgtcccggagtggattttccactcacctgtgagtggatgaacactttgggtgtcaaatcatattttccgtagtggattttatagccatcggtggcattcctatttaagactagtgatgctaatttcaggaagagaagagaaccaaatagacatatccaagaccacagaggtagattgttttgtggttgaattaggaagtctacacaagtaagtgtgaatacccaaaggcttgtattttatttttaattctctaagagggtatttgttataatatctgaaggggattatgcatctcatagcattgcaatgaataaatgaatattgtattttcttcactttttaaaaaatccaatgttgacttacattgtataatatacaaatttttgccactttatagagcagacttccttatgttacatttactttcatactgggtatattttattttactttattttttattggtagcgtctttctgagtaaaaaacaaataatgaattggtaagatgtatctcattcaatgtaagaacctaatggttagaaaagaaaaagaaaggtttttagttacttacttatagtttttctatactgctgagtatttttctttctactttataataataacattccaagaattattgaatatcagaccatttgtgggaagtttgggaatgtgtgtaaatttctttagaaatctttaaaaattacttctatgtgtaggtgagaaaccgcataagaaagcagaaatctagtaacaagtttcttccagcggtgaatgagtaaaataaaacacataaggcactgctaagttttaattatttaactattttaattaaaaaaataagatactatcagctaaggatagcatagcttatattccaaatcaataactctttgaatgagaaagccagaattttgattcattaatatacaatgcagcatttggtgtcatccaagaagatacttttcataagttccccctattctagttgcaagtaccgtttggtgtctttattcttttctttgagagagggtctcactctgtcgtccagcctggagtgcaccagtgtgactgtagctttctgtagcctcgacctctggggctcaaatgatcctcctgcctcagcctcccaagtagctgagactacaggtgcacaccaccatgcctggctatttttattttattttgttttatttcttagtagagacaaggtctccctatgttgcttaggctggtctcaagctcctgggctcaagcaatcctcctgcctaggccttccaaagtgctgagaatacaggtgtgagccaccatgctggccctcttattctagttttaccataactagttctagtctataaattcccattattttagctttgtttcactgtgaggaggcggtcattctgttcccttggaaacccttggccatgtctggagacatttttgttgtcacattggtggggcgtgggtggtcctggaacctggtgaatgaagctcagggacgctgctcaacaccctacggtgcccagggctgcctgtgtcctccagaaaaaaaaaataagctcttttcttccattccctatacccctgaaaaacgcgcagtcctacacggaacccacagcgaattttcaccaagcacgtggccaccaagtcatccagctccaaatgtcagctggaccaaggtggaaaaagcctggtccagtgcattttacccagatcttcaaagctcctctcacccttgtgtctcccccatccgtgtggagctttacttctgtatagatcctcaggaatcgcctctgctcttgctgcctttacagactccctctctaggtttgtgtcctgagccaagaaaggaagaagaaattccagtgaaaagtgtgacaaattacatttctccacgttaaaggattcaaccaactgttgaatcctgatgaattttgtctgggttgtgattatgtcttagactttcttgtctaaactctactatcatcaagataacttggtgaaaattcactgcaggtttcattcaggacagcacagtttgcaggtgtatagagaatggaagaaaagagcttatttttttttatctggagaacacaggcactttcaagagtagcttcagtgcctataatatttttgttaatgaatattaatggagtattttaatgaatgcagagactgctttggattttattagttgaccttaaacagcactttgctcatgcagcccaatttacctacatagacctgggagcactgatgttattaccatccttcgtcattgagaacagaaaggttaagaaggtgatgtccgggtagtgttgctgtttcctgagatgaaaggtctcataaaagtaattattgttttggtttcacctgcggtggggaaatgccttgtagaattatacagttctaccatcaaagtgacccaggaaaccgaagtgactgagggcatctctcttgttattttaattttaaaaattttacatcttaggccagatgtagtggctcatgcctgtaatcccagcactttggaaggcagaggcaggtggatcacctgaggtcaggagttctagaccagcctggccaacatggtgcaaacccatctctactaaaaatacaaaaattatctgggcatggtggtgcacgcctatagtcccagctacttgggagggtgaggcaggagaatcccttgaacctgggaggcggaggctgcagtgagccgagatcgcgccactgcactccagcctgagtgaaagagtgagacgccatcccccccaccaaaaaattacattttaattgataaatcatatttatacatatttttagggtacatgtgatatttttatacctgtatacaatgtgtaataatccaatcagagaaatcaggatatttatcacctcatttatcttttctttgtattggaaacattacaattctttcttctagctattttgaaatatgcagtaaattatctaatctccctattttattttttatttttattttattttgtaatttattattattgttttttcataatagaaatggggtttcaccatgttgcccaggctggtctcaaactgctaagctcaagctatcctcccacctcggcctcccaaaagactgggattatagacgttagccaccatgcccggcatatttttgtttcaataaaatacagccaaggtttcactatgttgcctaggctggtcctgaactcctgagctcaagtgatcctcccaccttggcctcccaaagtgctgggattataggtgttagccaccatgcctggcctatttttagtttaatagaataaatagagagaaggtctcactaagttgtccaggctggtcctgaactcctgagctcaagagatcctcccacctcggcctccctaagtgctaggattacaagcgtgaaccaccacacctggccccagtctccctattttaaaggaaacagcattccagattcagtacgaagacttgcaaaagccacatattgaattaatgtgaaacaggcatcatctctggtttttttttttaagttaaattttaaacaactattatagataaagctcaacttggccaaaacctgtcttcaccactgtggctcctgactttacctgggggttgcaattcctatgagccttttccttccagatatctgccccactttgataaacattaatgaaaagggaaatgttgatgtgtgaatgcgttaaataaaaggtatcatactgtatatattttcagaaaacttatttaaattgaaaaaatactgtactatgtatcttggaaatctactgctattactagacatagaactatcttactcttgatctgatgcatagaatctcatagtaggaatatacaccaatgtatttagccaatctacttcaaagaggggagatttcagttggtttcaatatgactctacttaaagacaatgttggatgaaacatccttcctccatcctggctccctgcactgagtgtggggctagaagcacgagtgctttgctaaaatttaggctcacttttaagtcttgatatttagtggcaactgaaggtaacttgctgtgaattcttcttataacatatattttcacactttaaaagtttttggtgttttgatagtgagccattctatctcattatccttaacatttactttttctagttgatgggaaagttaaaaatattttatgtgcctattgataatttgtaatttttggggtctcttttctaatttatttatcgaaaatatggccaggtggagtggctcatgcttgtaatcctagttcttctgttcctggaccaaaccgagggtttggctgctatttcttgcggctcaataatgagatgcagatgaactgagagagaagggagtttttatttctgtaaccaggtacagggagaaggcctagaaattattgccagaccaactcaaagttacaaagttttctagagcttatctacctgctaagcaatgtgtctatcagtaagtgtgcactcatctaaagacattagtgatgaacttcttctaatctagaacaaaggtctgagtcctgaagaccttcctctggagcctcagtaagttcatttaatctaaatgggtccaggtgctggggtgattacccttatcttgtctctcgctaaatcatggaggtttgaggagttctttcagaccctctataaacttgtttgtggaggtctggggagtttcatcagacccccaataaaacctgtttaatcctaaacgggtcctgttaagaatgccttcgttgtcttgtcatgcttcaaggcccaggagaggcctgggcagaactcttggtgggcttttgtgagattccagcctttgtataagggcgctggctctctcagcttttaatattgaacttcaccactcggtcagtgctgaaacagatgtcatggaggcctgcgttagtgagacctggcctgccacactttgagaggtcgaggtgggaggatcacttaaggccttaaggagtttaaaaccagcctgcaaaacatagcgagaccctatctctacaaatagtaaaaaaattgccaggcatggtgcacacttctagtcccggctactcaggaggctgaggcagaaaaattgcttcagcctatagttcgctgtgctccagcctaggtgacagagcaagactctgtctcaaaaaaaaaaaaaaaaagggaaatgttacagagattttttccttccctgtaactcctttttgctttgtcgatggtctataaaactgttttcagttatttatattagtttcttgtggctgctgtaacaaaataccgcaaactgggtgacttaaaatgacagttattctctcctggtactggggaccagaagtctgagatccaggtgtgggcagggctggttcctcctaaggcctctctccttggcttggagatgctgtcttctccctgtgtcctcacatggccgtccctgtgtgtgtgtgtgtcctcatcttctccctttataaggacaccagtcagattggattagggccagccctggtgatctcattttaccttaattatctgtttaaaggccctgtctttaaatacagtcacatcctgggggactaggagctaggatttcaacatataactttttggcagacacaattcagcctataagagattccactccttatttaatcagaggaatttaaagatagctactttaaagtcctatcctggtcgggcacagtagctcacacctgtaatcccatcactttgggaggccgaggcaggcagatggcttgggttcaggagttctagatcagcctggcctgcatggtaagaccccatctctacaaaaaatacaaaaattagcctagtgtgatggcttgtgccagtggttccagcgactcgggaagctgaggcaggaggatggcttgagcccaggaggcagaggttgcagtaagccaagatcccatcacttcacactccagcctgggtgacagagtgagatcctgtgacaaaaaaagtaaaaaaggaaaggcaggaagacagggaggaagggagggagaggagagagaaaaagaagaaaagaaagaaaggaaggaaggaaggaaggaaagaaagaaagaaaagaatccactgcactccagcttgggagacagagccagactgtctcaagaaaaaaaaaaaagcacgaaacacaacaacaacaaaaaacagatgactcaggataagattctttccctttctttctttctttctttctttctttctttctttctttctttctttctttctctctctctctctcctcctttccttccttcctttcttccttccttccttcctttctttcttccttcctttcttttttgtcacaggatctcactctgtcacccaggctggagtgcagtggtaggatcttggcttactgcaacctccatcttgtgggctcaagcaattctcctgcctcagcctcctgagtagctgggattacacgcgtgtgccaccacatccagctctttttttttttttttttttgagtagagatggggtttcaccatgttggccaggctggtcttgaacttgtgggctcaagcagtcctcctgccttggtctcccaaagtgctgtgattacaggtgtaagccaccgcgcccagccgctgagtcatctgctaattcactggacttctgcacaaataatttccctcattcattgctgttggctgaccccaactgtgtggtgactccataataggccatcattaaccatcatcaaattccctgtgtcctggctggtgacatctcactccagtcttataggtgtttctctggcaccctcagatgcttccagcattgacattgctagctactgtgggttcccatctgtcttccttctcttctagagcatgactttaaaaaaacaaaagaaaacataaacaaaaacaaaaaaccatatctttcttgtttttaaagcatgactgcgctcttgcaatctttgtctaattctgtgactttggcccagccgtgttcaaagtccaccattctgaaatggaacccagaatttggttttgtgatgtttgatctttcttcttctcccttttcccactgtagtgtttccttctgtttttttttttttccacttaagagtctcaatcaagttgatgatgtgtagacagtcctcagtgaccatttattttattttttagtataaagtaaagggctacaagtgcggctatgttgcatggatagattgcacagtggggaagaccaggttttcagtgaatacatcacgaatagtgtacattgtactcactgagtaatttctcattcctcatcaccttcccacccttctgagtctccagtgtctattattccactctctatgtccatgaggacactgtgtttagctcccacttataagtgaacatgcagcatttgactttctgtgtctgagttatttcacttaagataatgccctccagctccatccatgttgctgctaaagacttgattttattcattttttctggctgagtgcatgtgtgagtgtattatataaactggatatacacagatatatatatatctcacatttatttaaaaacacacagaatggccagatatagatatatgtatctcagatttcttacatatataaatatgtgtgcgtgtgtgtgtataatctctcattttcttttaacttttaatttttattttaagttctggggtacatgtgcagcatgtgcaggtttgtcacataggtaaacgtgtgccatggtggtttgctgcacttgtcaacccaccacctaggtattaagcccagcatacattagctatttatcctaatgctctccctccccctactcttaccccccaacaggccccagtgtgtggtgctcccctccctgtgtccatgtgttctcattgttcagctcccacttataagtgagaacatggggtgtttggttttctgttcttgtgttagtttgctgaagataatggcttccagctctatccatgtccctgcaaaggacatgatctctttcctttttacggctgcatagtattccatggtgtataagtacacactttttaatccagtctatcattgatgaacatttgggttgattccacatctttgctattttaatctcacattacagtcatggctacgggcagcagagtgagaccctgtctctaaatgaataaataaataaataaaaataaccttgattccttgctagttggagagaacattgcactggtggctaggaccattcatggtgatccttactaatcttgtcctggagagatgcttattaaaggagggtggaaatggctaaatatggtgaataaaaagacgatattctcaattcatccatgtttctgtctctgtctcacctaactattgggaaactctggattttctcggtgtgaactttatgggaatactaaatagtatattaggcagtggagttacagacatgagaaccagaatgtgatattttttaaatgtcacattgtgggcaagtctaatatagaggtattaattggaagttgtggggtagagaaaatggaccactaaacggttagaacgtgggcttcaccaaatgccccaaggtagttagtctttaaggatattacatttgagagccatattggagggttgaagttgagaagatggcctggggaattggctaatttacacacacacacacacacacacacacacacacacacacacagactcctgagaatcagtccttattttgaatcccagctcttcaatttaccagccttgtgaaagtcttttaagcgatatgaaacccaattgcttctcctagaaaacggaagagtcatcattaaccctttgaggcaagcggggtgagatattttgaggatcaaatagtaacaagtgtgtggaaatgcctggggaattataaagctctgctaacattatggcggtgctattaatctttattatatattatttgtcttgtggggcagttcctcagcctataaagcctcaccaacttggaatcacttgaggattctaggcagggaaacaccagattgtaccactggttgcattcttgtaaaaatatcttaattacagctgctaaacatgtcttcctccaccaaacaagtctggcctccatgactatcacaggtctatggtgtttcttgttgtgctttttaaggtagataccacagttgatccagtatgtgtaaaaacaaagtgctttccagaacagtaccacacataaattagatctgatacaaagcagttattgaatatatgcacattcattgattactgatttactttactgacaccagaatagtaggtttttgttgctataccaacgtaatttcttgtaactctgccattagaattaacctgagctgcatagaccatgcatagaattttgccttattctttgtgagcaaatatcacttatttgcaaatacgtttaaagaatgtgctgggctggccaggcacagtggctcacacctgtaatcatagcactttgggaggccgaggcgtgtggatcacttgaggacaggggttcaagaccagcttggccaacatggtgaaaccctgtctctactaaaaatacaaaaaattagccgggcatggtggtgcacacctgtggtcccagctatttggatggctgaagcatgagaattgctagaatctgggaggcagaggttgcggtgagtcgagtcgctgcactacaccctgggcgatagaacaagactctgtctcaaaaaaaaaaaaaaaaaaaaagaatgtactgggtttactgggtcaccacaaaacaatctagttaagcctttggaccattatctgcctagctatgaggaaaacatttgctttgcagatgctcttattttattcttctcttccttagataatctaagaagaagccatgaagcaattgctgtatgactggtgagctggcaaattcacgaacattcatcactctccatttctagagagaaggattctttgtcaaggttttctctatcctggaggacttgggttaaatatgtgcttaaaatgtcctttatgagggtggattatcaattattcctcatattttattcaagctgtgctttctattttttgtcttttatttatttatgtaatttttttcttttttatagagattgggtctcactatgttgcccaggctggtctcaaactcctggactcaagggatcctcccatctcggcctccctaagtgctggaattagaggcatgagctgctatgcccagcctactgtctatattttcaagccataactaaattcacactggtttatgatgttcatatcatctttgtggatttgtatttttattattctataatagtcttgccattctatattaatgatttttcaattgtaattttcttctggctgatgttattattgttacaagtttcttttgattactacttggctggcctacttagatgtttacatctttttagtttcaagttttgtttgtcattaggttttaggtgtgtcctttaagaaagacataggacagatttttaaaaattagtatgggattctttaataggcaggtaaacccacccacatttgttataaatattaagatagttgatcttatttctgtcatcttacatgctatcttatattttcaagattctcctgtggttttcttttttcccctcttgctttttacgggctgcattaagggttctctgtttcctggctgatatggtttggctgtgaccccacccaaatctcaggttgaattgtaataatccccacgtgtcaagggaggagcccagtggagataattgaatcatggcagtggtttcccccacactgttctcatgatagtgaatgagtctcatgagatctgatggttttataaatcggagttcccctgcacaagctctcttgtctgcctccatgtaagatgtgcctttgcttctcctttgctttccaccatgattgtgaggcctcctcagccatgtggaactgagtctattaaacctctttccctcccacctgtaatcccagcactttgggaggccgaggtgggcagatcacgaggtcaggagatcgagaccatcctggctaacacggtgaaaccccatctctaccaaaaatacaaaaaattagccgggcgtagtggtgggcgcctgtggtctcagctactcgggaagctgaggcacaggagaatggtgtgaacctgggaggtggagcttgcagtgagctgagatcgtgccactgcagtccagcctgggcaacagagagagactctgtctcaaaaaaaaaaaaaaaaaaattacccagtctcaggtatgtctttattagcagtgtgagagcagactaatacactggcccatccttctcccctcaagtggcctggtaactgtacctcatgtttcccttaatcatattaacatcattattaacttaccaaaatatgatggttaatctctatttccagcttccttttgaagaaaggaaagactggagaatgtttgaacactacagtcctaccccccccgccccaccttcctccatgtaattaccgcttagtgaattatttactcctttccaaaataataataattaataatagtttctgtcaatgcgtatttaatgttatcaacatgttttatctcttttcaacatcttttcttatgtctacccttttatttttatttatttatttttgagacagagtcttgctctgtcacccaggctggagtatagttgtgtgatctcagctcactgcaacctccacctcccaggttcaagcgattctcttgcttcagcctctctagtagctgggattacaggcacatgccaccatgcctggctaatgtttgtatttttagtagacaaggggtttcactatgttggccaggctggtctccaacatccaacctcaagtgatccacctgcctcggcctaccaaagtgttggaattacaggcatgagccactgcacttggcctgtctactctttctttctaagataagtttgccttttgctgaaaatattccttagtagattttcatcaagagtttttgggttcatgtacaatccaaatgcctgtaatccctattcattcttcaatgatgtattagaagggtttggaactctgagttcagagtgacttttgtctcagcactctggaagcaatggtccctggtcatcaggcatccactgtggctgttgggaagtctcttgacattccagttatcctcccattttaggttatctgtggttgtgtttaaaccaagtgcctctgtctccatcattgccctttactgagctaggtctaactggaggtttttaatttttttaactgggttcagtctgaaaacttatgtctgtcttcaatcctgaaaaattcttagccaagatatctttcaatgtatcatctccctatcctcatccttaaaccctcttaatagtaggctgggactttttgtccaaaaccatagaatgtacaacagcaagagtgacccttaaattaaactatggactttgggagataatgatttctcaatgtaggttcattgattgtatcagataatgtaccatcttgttgccgggtgttgataatggaggaagctattacatatgtaggggcaggggatatgtgggaactttctgtacctatgctcaatttttctgtgaacctaaaactgctctaaaaaataagtctatttaaaaaaaaacatgagcttgagatttaataaaataactactattaatatttaaaaaagaaataggtcagacactgtgcctcacacctgtaatcccagcactttgggaggctgaggtgggaggattgcttgagctcaggagttcaagaccaacctggccaacctagtgagacccccatctcaatttaaaaagtttttaaaataaaaatataaacatgaaatagaagggaagatggatggatacaaaaggatttatgatataatatttgaggttgaattaggaggacttggaattgattgaatggaatttggagttggggaacctgactgaggggatattggtcttcaattcatagtgatcatttttgatcaatggctgttgtgaatatttcaggatattgtacaattcagctgttacaagagggttcttttacaatctaaaatttaggccgggcgtggcggctcacacctgtaatcccagcactttgggaggccgaggcaggtggatcacctgaggtcaggagtttgagaccagcttggccaacatggcgaaccccatctctactaaaaatacaaaaattagccaggcatggtggtgcacacctgtagtcccagctactcaggaggctgaggtgggaggatcgcttgaacctgggaggcagagggtacggtaagctgagatcgcgccattgcactccagcctaggtgacagagtgagagactccgtctcaaaaaatacataaataaataaataaataaataaaacttagtagatctattccaacattgacccattgaaaaataaaataaaatttagtaaaatctgcctttcattgaactaattgacaaaaaaaatttagcagaatctcaaaaatgttaaattttctttcatagattttaaatgatttctagattgtttttgaagtggaattttttccacctgatttcttctatggacatatgttcttgatgaaccaaaggagaaaacagtttctatacacacatgtgttccatccccaaatatcagtgtttcagcatctagttctgggcttagatctaataagttactggagcttctgttataattgcccccaccccgctccatgtggcttagagaaaacctttgaggttataaaatgtattaaaaagtacaactgaacacttgaaaaatcaaaactgactcgctcttagtctctgattttccattttgcttactttttttttttttttttttttgagagagagaatagtttaataaagctctatcagccaggcgcggtggctcacgcctgtaatcccagcaccttgggaggccgaggcaggtggatcacgaggtcaggagatcaagaccatcccggccaatgtggtgaaaccccgtctctactaaaaatacaaaaaactagctgggcgtggtggcgggcgcctgtagtcccagctactcgggaggctgaggcaggagaatggcgtgaactcgggaggcagagcttgcagtgagccgagactgcgccactgcactccagcctgggtgacagagcgagactctgtctcaaaaaaaaaaaacaaaaaccctaaagctctatcactcagcttcaaaaaaaaaaaaaaaaaaaaaagaatacgtgaatactgacagagttaaaccttggaaagtttcttttctaaaaaggaaactttaaaagtttttatttttaattgacaaataataattgtttataggctgggcacgatggctcacacctctcagcacttcaggaggccgaggtgggaggatcacctgaggtcaggagttcaagacatgcccggccaacatggcgaaacgccatctctaccaaaaaaaatacaaaaatcagctgggcatggtgccacacacacatacacacacacacacacacacccctataagcctcataaatatgaacaattattattattttttgagacagagtctctctctgttgcccaggctgcagtgcagtggcgcgatcttggctcgctgcaacctccgcctctcaggttcaggcaattatccctgcttcagcctcccgagcagatggtattactttttttttttttttgagacggagtctcactcttgctacccaggctggagtgcagtggtgcaatttcagctcactgcaacctccgcctcctgggttcaagtgattctcctgcctcagcctctgaagtagctgggaccacaggcgcgtgtcaccatgcccggttaattttgtatttttagtagagatggggtttcaccatgtttgtcaggctggtctcaaactcctgacctcaggtattccacttgccttggcctctcaaagcactgggattacaggcatgagccactgtgcccggccttggttacatttttattcaataaagtaaacaaaaaagttttttttgagatagggtcttgctctattgtctaagctggagtgcagtggtgcattcatagctcactgcaatcctgacctctcaggctcaagcaatcctctcatctcagcctcctgagtagctgggattataggaatgcatcactatgcccagctatttttgtattgtttgtagagatggggtttcaccatgctgcccaggccagtctcaaacttctgggctcaaatgatccacccgcattggccttccaaagtgctgggattacaggcatgagtcacagcacccggcaaaattcaatttttagagcttaccctcaactgtaacccctgttataaattttaagcctctgatgtcactaaaacaatatcaaaagatgttataagagttaaacctcatcatgcttgcaaaatgaattggtaaaatatgatgccatattcgtatagaacaatggtctccaacatttttggcaccagggtctggttttgtggaagacggtttttccacagacaggaagggggtgcaggatggtttcaggatgattcaagcacattacatttattgtgcactttatttttattattattacacgataatatataatgaaataattatacaactcatcgtagtgtatgatcagtgggtgccctaagcttgttttcctgtgactagatgatcccatctgggggtgatggaagacagagacagatcatcaggcattagattctcataaagagcacacaacctagatcctttgcatgcacagttcacaatagagttctcgctcctatgagaatctaatgctgctaccgatctgacaggaggtggagctcaggcagtgatgcaagcaatggggagcggctgtcaatacagatgaagcttcactcatttgcccaccactcacctcctgctgtgtggcctggttgctaacaggctacggaccagtactggtccatggccaggggattggggaccccggtatagaacattagtttttgttgttgttgtttaatctagtttctgagtaagacaacacaggtacgttgtacagtgagaactgataacgaatatcactgtttcatatgttaagttatctaaaatgcaaatgttaattgatagtgcctggttttttgcttgcttgtttgtttgcttatttctaaaaatgctttcaggagctgctggctgtcagtgtccctgtgctgtttgttttgcggtgttgatggcacatttatgacaagaaacgccagacccaacattgtcctgctgatggcagatgaccttggagtgggggatttgtgctgctacggtaataactcagtgaggtaaagatggactctgaccccctccctgtatgtgggagtctcccttaccacagtgttcacgtctttgccgttgcagagaagggtttctggagagaagtcattgtctgatgttatcggcaggaatagcagaggtcactggggaaaattgcaaaatgtcaggagaccacttaacctcccagtttccttagattctagctgttggtggtggcgttttcattgttgggcaaaatttacatttaaaaattggccttttttgatcaggcatggcggctcaagcctataatcccagcactttggaaggccaaggtgggagcattgcttgagcccaggagtttgcgatcagcctgggcaacacagggagaccccgtctctacaaaaataataaaaaaaaaaatctactgggacatggtggcgtgtgtctgtggtctcagctactcaggaggctggggcaggaggattgcctgagcaagggagattgaggctgcagtgagctatgatcccaccactgcactccagcctgggtgacagagggagactctgtttaaaaaaaaaaaaaaaaatcaccttttaaccattttaaagtgaacaattcagtggcatttggtacattcacagtgttggacaaccgtcacccccacaaagaagacccccatttcccatcctatccccatgccctgttaaccacaaatgtaccctctgtctctatggatgtgtctcttcttagaatttcatatacaagtaatcatataaagtatttattttctcaggctgccgtgacaaaggtccacagactggttggcttagataacatcagcttattctctcacagtcctggaggctggaagttcaagatcaaagtgtgggcagggctggttcctcctgaggcctctctcctgtccttgtagatgccgtcttctccctgtgtcttcacagggtcgtccctctgtgtgggtctgtgtcctcatctcttcttcttatgaggtgtcttagtctatttcaggctgctataaaagaataccatagactgggtggcttagaaacaacagacattgattctcccacagtcctggaggctggaagtctgagatcaaggtgtctgcagggctggttcctcctgaggcctctctcctgggcttggagatgccgtcttctccctgtgtcctcacagggtcatccctctgtgtgtgtctgtgtcctcatttcctcttcttataaagaccccagtcctattggataagggtccactttaacgacctcatgctaccttaatcacctctataaagactccatcttcaaatacagtcacattctgaggtcctgggggttaggacttcagcacaggaatttgggagggacacaatttagctcataacatatggtaagtggtgtttggtgactggcttctttcacttagcgtgatgttttcaaggttcattcatattgtagcatgcgtcagcacttcattcctttccatggctgaatactttttcattatatacatacaccacattagtctacagttttaaaaatatcttccttgaattacttctaaagtctctggtacccggggctctttatttctctactctctatcgatagaccaatctggctcttgtaaaaatacatagcatcttttagtgtggatttaaataacattgtttcttcttggaatgcagatcacagtctagtcctatatcttaagcatatatttgttgattgaaaggcattggtcttcttcttcttattttctttctttctttctttctttctttctttctttctttctttctttctttctttctttctttcttccctttttcttttcctttctttcctctatctcttttttttccttttatttttaagacaggatctcattctgtcatccagactggagtgcagtggcatgatcttggctcactgcagccttgacctcccaggctcaagtgatcctccctcctcagcctcctgagtagctgggactataggcatgagcccccacacctgcctaatttttgtggtttttcttttgttttgttttttttttgttttttgtttttgtagaggtggggttttgccatattgcccaccctggtctgagctcaagtgttcagcccctcttggcctcccaaagtgctggggttacaggcgtgagccatcacactcagcctccattatcatctttctgtgggattatggaaaaaaaatgttgtacccatgggatcaagattggatatggtttagcttttaggagaacaggcacgtcttttttttaacctataagttttacaaaatttttgcaatgtattagacaaacaaaatgggaaataaattaaactccaaaatgtcacaatttggtcataaaataggtcaattttaccgtaagatatatattaatgggaggctgaagtgggaggatcatttgaagccaggagtttgagaccagcctgggcaaaatagcaagacatgtatctctgcataaaattttaaggccaggtgtggtggatcacacctgcaatcccagcagtttgggaggctggggaaagtggatcacttgaggtcaggagttcaagactagcttggccaacatggtgacacctcatctctactaaaaatataccactgggcgtggtggctcatgcctgtaatcccagctagtcaggaggctgaggcaggaggatcacttgaattgggaggcagaggttgcagtgagctgggatcgcaccactgtactccagcctgggtaatagagtgagaccacgtctcagaaaaaaaattaaattaaatacaaatttaaataaattagtagggcatggtagcgcacacctgtggacctagctacttgagaggctgaggtgggaggatcacttgagcccagggaatttaaggttgcagtgagctataactgcaccactacactccaccctgggcaacagagcaagagactgtctcttaaaaaaatatgaaacacattaaaattttacttaatctaaattacccattaattttaggtccttgataagaagaaattggctaatttttccattgaaatacatttttttctcagactcataaaactgtataccgagtgacctgtattcatttgtaatagttttgactaaagatatattttaaacttatgtttccatttgcttctaaccatcaatgcatataaggaaatagacagattaaagttttaaaaagatggattttaggtttaccagaaatagagtcaacttgacccaaaatagaatagctttgatccttgatcattgtattgagaatttttagaaactcacctgctgaattcttctttggtctgcagcacacctaatattgaccgcctggcaagtgaaggagtgaggcttacccagcatctcgcagctgcttccatgtgcaccccaagtcgggctgccttcctgaccggccggtaccccatcagatcaggtgaggcaataaaaaggcagcaacatttcagtctcaccagaatgcattctaatgattagtttttgcaaatctttataagaattctcaaaaggtcactcagagtattagggatctaaattcaaaggtggttgttatccctgggcagcttaaatatgtgtgcctctcaccaggtaccactgcacctgctcatctctgtgcatatagcgacagggtttaggcctcttgggggcaatttgccaacttatggtcaacactcccattttcaggtacttgtgctaagatttctcaagagacccctgatgtctttaagctagcagagaccatgcagtggttctgagataagtggatcaaatccacctctgtggatgagattggaaaactagacacagttgggaaaaaaggtataactgagaaaacaaaaaggaaatgaaacttttacatactcccttacttgaccccatcatttcaagatttagacttaccaagttgatataacgacaattaaatgtgttcctttgctgcttagcttaggatcaatacctacaaacatccactcaagatcaatattatgaacaacaatttttatacccagctaaaatatagtggtgcccttagacactattgaagtgttcatggttatcagactctatgtgaaatatcgtgtcatgctgttgcattttgtttaattctagtatttgcttgtcataattttagtatacctgccttcacagtttaatttttcagtgaaaaatttttctgtatgaattttcttcctcctaagtagtagattctcatccaatacattcaaggaatgaactaattaggttaatgagaattatactaaaattaagagtaaacattaaaagtttttgtcccataaatattgatttattattatctttttttgttgcctaatgaccttctttcataattcaaggttctccattttgttcaaaatagtttggtttctagataagcagtctctatataacacagtaccgtgtatgaagagggataaagatatgaatttgtatgagtttccaaaaaaaactacacttataatttcaggatttcaggattttttctttttttctttctttctttttttttttttttgagacagactcttgctctgtcatccaggctggagtgcaagggtctgatctcagctcactgcaatctctgcctccctggttcaagtgattctcctgcctcagttcctgaatagctgggattacagtcatgcaccaccacacccggctaatttttgtatttttagtagagatgggatttcaccatgttggccaggctggtcttgaattcctggcctcatgtgtgatccacctgccttggccacccaaagtgttgggattacaggagtgagccaccatgctctgcctaatttcagggaattttaagtattgattatggtgaaataaaatttatttttaaaaattaagaaaaaaattaggtgattggtggagagatttcaagtcattgccatgtgtatatttttaatcatttgacacaaacggttcagtttaattcattctacttatcaaaaatttcagcaaaacagttcaacagcaagataatggtctaatgcttcccttaataaaactgtttctctttcctatcaatgacactatctagagtctactttcttcttcttccaaggtaggatccttgaaatatacttttttcttttgagatggagtttccttcttgtcacccaggctggagtgcaatggcatgatctcagctcattgcaacctctgcctcccaggttcaagtgattctcctgcctcagcctcctgagtagctgggattacaggtgcctgccaccaagcccagctaatttttgtatttttagtagagacagggtttcaccatattagccaggccggtctcctgatctcaggtgatccaaccactttggcctcccaaaacactgggattacaggcgtaagccactgagcccggcctgaaattatcatttatttatttcttgctgatcttcacttgtggttttcttgtgaattccttttaaactataggtgtataatattgtccaccagtataaatctacataaaattatatggaggccaggcacggtggctcacatctttaatcccaacactttgggaggctgaggtgggtggatcacgtgaggtcaggagttagagaccagcccggccaacatagtgaaacctcgtctctactaaaaacacacacacaaaaaatagccaggtgtggtggcacacatctgtaattccagctagggaggcggaggcacgagaattgcttgaacctgggaggcggaggttgcagtgagccgagatgttgacactgcactccagcctgggtgacagagtgaaactccatctcaaaaaaaaaaaaaaaaaaaaaaaaaaaaatatatatatatatatatatatatatatataatatatatatgtatgtgtatatacacacacacacatatgaaaaagaaattgtcactcctacacttcttcatttcagattctcaaggatacttttaaaaatgtatttatacccagctaaaatgcagtagtgtcctcagatactattgaaacattgaaggttagcagcctctatatgaaaaactaacgaaggttatttgttgttagtctgaaattcaaatggatataactaagtgtcccgtatttattctggcaaccctaattccaagggaatgtttgcatttagcaagtgaaaaaaggagggtcaaggacgtacagccagaaagcaacagaaaacttggggaagaatggctttgaggaggtgcgggaggagaggactttaagcatgtcgggataaattcggtattagcaaagactatggtgctaacttattgacttctgtgaatttagggatggtgtctgcctacaacctgaaccgtgccttcacgtggcttggtgggtcaggtggtcttcccaccaatgaaacgacttttgccaagctgctgcagcaccgtggctaccgcacgggactcataggtatggcgccggaactctgcccgtggaaacgtgatcctgcagcctctctgtcatcgtgtctaaggtgtttccggggatgttggctttgtgcgcgccagtttgaccgacttctctttgagataagacacttggagaaggaaatgatcacacattgattgagcatgtgtagaatcgagggcatagtattggaaaaacaatgagaacagaaagcaaacaagtgtatccaaagttgccactaaaatggaatgttgtgttggagggatacgatgtttgtgacaccattattagcagaaaaaccagtaaatttgtagagaagtactgttgaaatgggaaacttacagcattaagagttgtcaaatggaggcaattgctggtcgacttagatcacttaatattctatgcccttttggcgggggtgggggtttggggcggggggacatgagcttgtgagggagcctttcaccgaaaaataagtttgtagaattccagtcctagaagatagtcctctaagaataacttgtgtgatcaaatccttttgggaaatgctactcaaaagcattgtacggtccactatttttgaggattcctaatgtgaattgtaagccacagctccgagatatccccagttaaaaaaaaggttaagaaattttctatcagtagggcatgtattcccatgcaactcccagcagcgtcctgtgagtgggaattctctagattagctttgagcagcgttcttacatcattagagcacgggattcagatctgactctgctattattcattaatgtgactcaggcttctgaataaatctagatagctgggcacagtggctcagacctgtaatcccagcactttgggaggctgaggcagaagaaggccaggagttcaagaccagcctaggccaccatagcaagaccctggatctacaaaaataaaatgttaaaattagctgggcatggtggcacgcacctatagtcccagctactcaggaggctgaggcaggagaattgcttgagccaaggagttcgaggctacagtgagctataatcatgccactgcgctccagcctgggcaacagagcaagactctgtctcttaaaaaaataatctagacaatgtgttttttattcataataaagggtctgggaagtgttgaatataataatgtgtgcggacaaatcagaacgtgacctggccccctagagtatgtgcttgataaaaggaattacttgcattatcagaatcgtttggttcttgatgaaattctttggctactttgtcatccctagcttgaggacctagaagaggtgttccatctatacataaaatctcggttacctttcagtgagatggaataagagggtcggaaggcactgctagataaaagcatgaatgtgcaaggtgcactgaaagtccttggtattgtccccaccaaacaaccaagacatcgattctgccctcctagcaagctccagatacctggaaagtttctcattgttcatgaggttgtttggtaccaagcaaaaggtttcttctgaatgaacactaggctcctctccttgtcgcaagcaaagaggctcctgctgcatggcttttgtctgaaagaggcatattgtagggagaaggctgttggtggcatgtctataccagggaggtatttggggatatcaagaaaaaaccatgatgacaacagaatgaaagttatatttgacttttccaaagggaagcccacattctagaaacagaccggcattgaatgctgccatgctgccatggtacgattttattttacttttaggcaaatggcacctgggtttgagctgcgcctctcggaatgatcactgttaccacccgctcaaccatggttttcactacttttacggggtgccttttggacttttaagcgactgccaggcatccaagacaccagaactgcaccgctggctcaggatcaaactgtggatctccacggtagcccttgccctggttccttttctgcttctcattcccaagttcgcccgctggttctcagtgccatggaaggtcatctttgtctttgctctcctcgcctttctgtttttcacttcctggtactctagttatggatttactcgacgttggaattgcatccttatgaggaaccatgaaattatccagcagccaatgaaagaggagaaagtagcttccctcatgctgaaggaggcacttgctttcattgaaaggtatttagccatttcttgcctgatttcctgcatggaaattttatttttatttcataggaggtcatcacaccttgataacatgggcctttaaaagtctcttggagagaatgtgcggcatttggctttctgttcctgtattaatttgcttagaataatggcctccagctgcatccatgttgctgcgaaagacatgatctcattctttttcatggctgtgtagtattttgtgggatataatgggagctaaacattgagcctccatggacataaacatggaaacaatagactgcaaacttctagaggagagagggagacagggagaccaggggcacatggttgcaagactacctattgggtgctctgcttaccccctgagtgcaatagacccacgtaacaaactggcacatggagaccctgtatcgaaaataaaagctgaggaaaaaaaaactttaggtgacatttgtgatagacttgagtctcctcttaggtagaattaaatagttaaatttcctgcaaattttgaatgctcaaaaggcaaaaaaacaaaaaccaaaacaaaaacaaaacataaaaacatattttgctcacctccccatttttaatgttttaattttttttttttttttttactttttgggacaggatctcactctgccacccaggctagagtgcagtggtgcaatcatggctcacagcagcctcgacttcccaagctcaagtgatcctcccacctcagcctccagagtagctgagactacaggcacctacaggatgcctggctaaattttgcattttttttttagaaatggggttttgtcatattgcccaggctggtctcaagttcctgggctcaagtgattcacccactttggcctcccaaagtactggggatacactacgcctggccacttacccctttttaaaaatgaaaactagagttgccatattttaatctatattgcttcagtgtggattgttatgtaaattgattaaacctggggggtaaaattttttttctctgtctcagacacagccggaagagctctctgtccataaactattggatagtggctctgtatttacagatacctagttttaagttttctgtgttcaacacaagctatgcaggcataactataatgagctctcatcatcccataccagctcactcctacgttacaaattattactattattatttggagacagggtctcactctgtcactcaggctggagtgcagtggtgcaatcatagttcactgaaacctcaaactcctgggcaccagtgatcctctcaccttggcctcctgagtagctgggactacaggtgcacatgaccacacccagttaattttataaaattatttttccatagagacaaggtcttgctatgttgcccaggctggtctcgaactcctgggttcaagcgatcctcctgccttgacctcccaaaatgctgggattacaggtgtgagccattgtgcccagcctgggttacaaatgaggggcacattaaagttgttggtgtggattctcattgacactgtttgtcaccttccttagtggggttggcagggagtggagaggggaggatatattgttactccaccaggctgaagggtatgcagtggaatatcattcactcatatgcccctgtgcccatcagattcattatttattccaacacaaccatgagaacagtgatcagccacccactcagctctccattcatcttacctgcccttcccgtcccaacccatttgcttgggctatctttttgggaatatattcaatctccatctccttcccttctttctatgctggttgtgaaaaatgtgtaaaggagtagctttagaatgactgcatgtgacattaaaatgcaaaacacaaggtcaggtgtggtggctcatgtctgtaatcccagcactttgggaggctgaggcaggaggattgcttcagcccaggagtttgacaccagactgggcaatatagtgagctcccatctctacaaaaaatgtacaaaattagccaggcttggtggcgtgtacctgtggtctcagctccttggaaggataaggtggaagaatcacttgagcccaggaggttgagccatgattgcaccactgcactccagcctgggcaacagagtgagactttgtctcaaaataaataaatacataaaatgcagaacacaaaaagcaagatgtaaatgaggggaatttatttctctcttggggtaggcaggctacagatacagtgaggttatcttgttctctgccatcctttgtgagcagcctcatggcccaaggtagatgccaaagctccagccatcagacttatgttccaggaaccatgaaggaggtggaagaaagaaagaagggaaaatggagagtaaggagcatcaaatccttactgtggcacatctgagtctgtccttaagatatgattcttctgaactcatacctaaaagaacactttgaaacaatagatgaggagaattcatactttttaacccattcaacaaagattaaaagatttattaagctgctactttatgtcagatgctaaactggacacaagagagtataaaatgaactgcgttaaacatttttgttgttgttgttaagacagggtctcactgcgttgcccaggctggagtgcagtggtgtgataatagctcacggcagcctccacctcccaggctcaagcgaaccccttgcctcagcctcctgagtagctgggatcacaggtgtgccattaagcacagctatatttttgtattttctgtagagacgaggtcttgccatgttgcctgggctggtctcacactcctgggctcatgcaatgctcctgcctcagcctcccaaagtgcaaagaatataggcatgagccactgtgcctggctacatgaaacattttactgggaacacaaatgttctgttatccttcattcctcctcatatcctttcaacataaatcttgtggtatttacgactcacaggagtggtattgtcatctaaagtacatagaaaacctccgccagctattatgagatcttttcatcagtgcagaatcgcatttaaatgatggaaatgacttcatatttgtgaaggtaattttggtaactttctaccccttaggtacaaaagggaaccttttctcctctttttttccttcctgcacgtacatactccactcatctccaaaaagaagtttgttgggcgcagtaaatatggcaggtatggggacaatgtagaagaaatggattggatggtgggtaagtattcagtaacagaactgtaaatatctgaagtacgggctacagaaaaacaaatctgtactaactgtctcaaattatgtccagccccttgcatagcatagatacctgaaaagtatctgtttcatcccttaattggattaaaagctggcttttaattgttcagcaataccagtgaaatatattccccaagataagtcacagtttgtaaatacaagttttcccatctttaaaataaagacagccacttttctgaaaaactcattggcaagataaagaaagctgcactgtaaagtatattgtaattcctggccgggcacgcagtggctcacacctgtaatcccagcactttgaaaggccaaggctggcagatcacttgaggtcaggagttctagaccagcctggccaacatggtgaaaccccatctctactgaaaatacaaaaattagccaggcatggttatgcgggcctgtagtcccagctgctcgggagggtgaggcaggagaatcacttggatccaggatgcagaggttgcagtcagccaagatgagaccactgcactccagcctgagtgacacagcgagattctgtttcaaaaaaaaaaaaaaaaaaaagaatattgtaatttcaattcccaattattttgatggatataaaagggaacgttattctgattagtcagttctacaggaaatacatagaaaattgggatggggatttaacacaactaaagcaacttatttcaaaggcatagtgttcactataaagaaatgctaaggataataaatgagcaggtgggaagagttactgtatgcattccagaataataaatagctgtgctagttgaattgcatttgcccacccccgcctctatgtacgtgacagagttgtccttcctctcagcgatggtgtttcattttggaatacagtacttttcttcttcttctgagtgcaaacttctgaaaacggtgctctgccgaaccattgaaacgaacaatctcccagttatcagccgcctctgttgacttatatggagtgcctttgaaagaaacagagctattttaatttaaatgcatttaaggggtgttaatcaatcacattttattataaataactttcttttctctgaaaaccaccatctaagtgagctataaaatactagttaaaattactgaagaactagtggtgtcggataggacaaagaggggaatcttgtcatgggataaatttctcttgtatatttccactatgtgtgtttacctctaattataggtaccattgtaacatttactgtctatatttaatcccaaagaggagatagaatacagagaggggccaggcgtggtggctcatgtctgtagccccagcacttttggaggttcaggcgggaggatcacttgatcccatgagtttgagaccagcctgggcaacataccaaggctccatctctacaaaaaaatacaaacattagccaggcatggtgtcacacgcacgccttgtagttccagctacctaggaggctgaggtgggtggatcacttgaacctgggaggtgggggtagcagtgagccgagattgcaccactgtactccaagaccccgtctcaaaaaaaaaaaaaaaaaaaaaaaaaaaaaaagaggccgagtgcggtggctcacgcctgtaatcccagcactttgggaggccgaggcgggcggatcacaaagtcaggagatcgagaccatcctggctaacacggtgaaaccccgtctctactaaaaatagaaaaaatgagccgggcgcggtggcgggcgcctgtagtcccagctactccggaggctgaggcaggagaatggcgtgaacctgggaggcggagcttgcagtgagccgagattgtgccactgcactccagcctgggcgacagagccagactcagtctcaaaaaaaaaaaaaaaaaaaaaaagaatacaaggaaagtcagtgctgccaggctgccagtaaggcatttaagcagaaatggggagaaaaaaggaatgtgttaaagggaaaaacttatgggcttagttaaagggaactaaccctgacatccaaacccttttgaagcttgctgaactaaagctaagctctgtatttcttaatttaatctttgctgtgggatgtgtatgtgtgtgtatatatatacacacccagctgcagttattttatttgcacggtataaattacaaatcacttttatgcataatactatagtcagatttaatatgaattaagctatatacacacacacaccatatgttatatacatatatatatacacacaccccatatggtttatatgtatacacaagttatgttttatacatatacacacatagcactgtatgttgcatatatacacatttattatatatagtttaattccttggtaacgaaatacaaacactgaaaggtgttacagttaaaaatagctataacactgtagcctttatggaattatataattgggattttttttttttctctgcttcttttgaaatcgcttactatagttgtacttagtcaaaggacagtttcccgtaaagggattttctgttaaagtctatatctgagtgtttatcactaagaaataattatgtttgttttacagtatatgtaaatacatgatgaagacgtgttacaaaagctagcaattgcattattaaatggctaatattatttgacacaggagaaatgatgagtagctatttttctgcgtaacatctcccaaatattctgagttttctccgtcatttcttataaaaattctaccaaaataaagacatattgaaagtcagacaggtatctctgtgggtattattttactatttaacaatatgagtataaaactcaaaggtttagtaacttattaactttactcaaaaataagccataacaatgctatactcatgcaaatgcaaatacaacgtgcaaaatgaacttaatgaatcttcgggaattcagtaacattttaaactttccaatgaaagaaacttgtgcctattaaaaaacacttttagtcctttttttttttttttttaagacacagggtctcactcttttgcccagtctggctggaatgcagtggtgcgatcacagctcaccacacacttgacctcctcggctcaggtgatcctcccacctcagcctcgtgagtagctgggactaaaaatgtgcaccaccatgtctggccaatttgtgtgtgtgtgtgtgtgtgtgtgtgtgtgtctctgtgtgttttgtagtggagttttgccatcttgcccaggctggtctcgaactcttgggctcaagcaaacttcccacctcggcctcccaaagtcctgggattacatgtgtgagccaccaggcccaaccttaatcacttttcattattggtttctttccaggtgtctttggtaggaggtcttataagtgacctattaccattagtatttatatattcatatgcatctgtgtgttttcactttagacactatacagacaattatttgcaaatatatttgttctggaacagaaaaagaatttgcagctactatatttgcacagtataaattacaaatcacttttatgatttttttatactatagccagatctaatgtgaattgataatttacatataattatgctgttcccagaaagcctttacaatctttcatcttacaaaccctgggctttaaaatatcttaatttctaattatagcatttctaaaaaatagtatatgtcacttctaaaacaaatcactgagtttacgtataaacagttttctgtgcagctagttaagctagttacattttcttttatctttgaatgggacaagagcatagcacagagatgatctagtgtaaactagaaatgcagtgtgacctcaggcccaggacgatgttatctgttgattagcaaatgctcaacagacatcagaaaggaaatgaatgttgtttggaattttgctagaacagctttctacttattattttaaaaaactgtcctcctgagggattgtcaacacattaaagacagtgtctgctgagtctagcgcagcattaattgtcattagatcttaaccataacccaaacagcaagaataacctgcaatttccatgtagacttcagatagcagccaggacagcaagtctctaagggaggtggtgctgtgccctggagtacggggatggctttgctcatatgttcctggaggtgtcattttgcaaactgtatttttttaaattaatgttcatcggtttatttaactgctgggccttcttggcactgtctatttgaatcgtttggggcaatgatgaccttatgtattattacacgatttgtataataaaatagattttattatatattcaataataaaataatgaacacattatacaataaaattgtataataaaccagtactttatatattgtatatgaactattctacattttaaattaatataattaatgtatctagtatatttaatataatttatataattacattaatataataaaattaattaaagtaatatgtgacacatatcattcaattatataaaataatatagtatatatttatataaagatataaatttatgataaaatttaatatattaattagacatatattataaaatttaatatgttcattatatattatacatttattacatatactcatattttatcttatagttaatatattttcctatgtcaataaacatatatttttacatattgcattgatatacaaaatactatataataaaataatagttacatgttattatataattacataacaatttttacacaatgataaactattatataatgatatgtttctagtattgtaaagtcatatggtataataatacatagtatgtattgattgtacatattacaatatattttgttctattccataattgattatattttaatatataacaattctttatgcatttttaatacatcatgttatatattaatatgtatttgtaagaaatatgtactatatatcatacaatatataataaatatataattagtaattcaaatgtataaaagtatgtattatagtaaatatagcatatattatacattattacattatatattaaatattttaactgctggatataatatatattatatacactatattacgtacagtttaaaatagtatgtattacaatattatatgattaattatacaatatcgtgtagtgcagaataacattgaaacgctatgtgtaataaatacatagtagcagatatgtaataaagcagtggtgatctgcatcaagaggtcaacgtctttgtgtctctgaccctctccaggtaaaatcctggatgccctggaccaggagcgcctggccaaccacaccttggtgtacttcacctctgacaacgggggccacctggagcccctggacggggctgttcagctgggtggctggaacgggatctacaaaggtgattgtgtgtagagaaccaacgcctgtccattttaaatcagtagtctctattggctttgtgtttgcttgaattcatttgccatgatgttcagatattttgatgtgagttagactcttattaagctagaccgaaaaaaaaaaaaagctgcaaattttggggcagtttccaagagcttcaaagtaaaatgtttgaagcaacgccaaccccaggagacagcacagcatctcaatgaccatctgtggcagatgtcccagcctccgcacgattgacatttgaggctggaggattctctggctgggggcatcctgtgccgttgtaggtgttgaacagcgtctgtgggctccacccacacatgccagtagcacccaccgcagagcagcaacaaccagaaatgtctcctgatattgcccagtgtcccctggggacaaggtcatttctaagtgagaagtgctcctttagattaatcctcacttggattctcagatgcaggtttttaattcaatcacaccaatgatgctattcattatgctttaactagtgttatgtggatcagaaaaaagagtttttcatttgactggggtgcctagctcctcatggccagcagattcttccagctcactttgatagacttcatgccgggttgttcaagaactccatggcacccactcttaggcatcaccaaaggcatgccaacagaaagaataatttaaaaaagaattctgcattcgctattttccccctacccgctaaccttccaagtaaaacaaaaaaactaaaagggtatcaaaatcgtcatcattataaaatcagaatgtttgaacttccttatatttcattaaaaagttctgtgtgtgtgtgtcttatatatgtattttcctggaggtataatcactatgtatataaattcaccgtattaattgtatgtaatataatatagaatcatatatattcatcatatgtgatatataatcctatatatagtcactatgtatatatagttactatattcattacacataacacatataatcctatatatattcgctatattcattatatataatacatgtaattttacatatttactacatataatatacataatcctgtacacattcactatgtatatatagtcattatattcattatatatacacacataattctatatatttactatatttattgtatagatcattatatataattttatatattcagtatatataatataatatataatactatatatatttactatgtctatagtcacatattaattatatatagtatatagaattctatatattcactgtatagagtatacataaccctacacatattcactatatgtactcactatattcattatatattacacataatcctatatatatattcactatattcattgtatatatataggattgtggatactggattatatattgtaaattaatagaagtgagctcctgaaagcattcacctcctctggcttgtcatgtggacttgctgtagtcataactgttaattagcaaagactaaattggtgctaaacctagtagaaaaagtgaggaacagatctgagtcaccatatatatgccatctaacgaagtgtgattattacagtcatgatgattctaacaactgtacctattatatattataataattattataattgcatgagtatgtgtgagtgtaaagcccctgtccttaaaaagcacacataaccctggaataggactggcaaaattgttgtgagcatttctcaggctttgggacaggatgcctgtttctcagggtgcttcctgtgaagcgatgaattcaatggatagagagatttagatctcctgggtaagcaatgggttttgttctagtctagttacacctcgcagctctgccccacaaagatacaggttattaaatacgatgaagaaaacatcaggatggctttatgattgtatgttaaaagcacatagatttggttcagtgagcttgtcgagtttttcttataataaagaatggtgctacttgggaggctcaggagggaggctcgcttgagcccaggagttggaagctgcagtgagctatgattgcgccactgcactccagtctgggtgacagaaggagacagtgtcttaattaaaaaaaataaaaataaaaaaagaatggtgccaagaagctgagctgcctttcaacactggttagactggttagatcagtgaatgtgtcagcagtgaattttacctcattttctgctagaggcttccggttttgtgtttctttgtaatgctgcctgtcagacaggtgcgcacgtagaagacattcaatgaaaatttcacataggaagagaccttttcctccagagaggttcctattttttcttaaagagtctagacatatggtcttgacactggcatttggcatagggccatttttctattctgtaacaaccgcctcagtctcatgattgatcttacggcaagggcttcatttttgttttgtgctcagaaacacccaaggggacttttgtctaagaagtgattctcaactctgcctctggccatttttctactcacactcctctctttcttcctctatatgggaaatcacggggtaaagttttttagcttgttcctcaaggatcattataatgtggataaaacctgtatttttcttttctttttctttttcttttttattttttggagacagagtctcaccctgtcaccgaggctggagtgcagtggcacaatctcagctcactgcaatctccacttcctcgtctctgatcccccgacttcagcctcccgagtaggtgggactacaggcatgcaccaccatggagtgcagtggcgtgatctcggctcaccacaaccttcgcctcctgggtttaagcgattctcctgcctcagcctcccacgtagcttggattacaggcgcccaccaccatgcccagctaatggttttgtatttttagcagagacggggtttcaccatgttggccaggctggtcttgaactcctgacctcaagtgatccgcccacctcggccccccaaagtgctgggattacaggcgtgagccaccgtgcccggccaatatggttgggttttaactcatctttggttgtgtcgtaatctttggttttaggtggcaaaggaatgggaggatgggaaggaggtatccgtgtgccagggatattccggtggccgtcagtcttggaggctgggagagtgatcaatgagcccaccagcttaatggacatctatccgacgctgtcttatataggcggagggatcttgtcccaggacaggtatggaaacagtgtttgctcctaacctagggtgatatatttgaacataagtggatatacttgataattctatgtgtgtgtgtatgtacatagtatattacttaattatcaatattctgcccatagggccagatgtctttctccccttggtgcgtggtggaatattttgttttcttcttagagtataccttaatatcctttgtcatattacacttatgcctgtgtgtgtttgactgttctcatggatgggatctgattctcatacatcatcacatccctcacagcttctagaccattatgcaattaagtgttaaatgattactgaataaaaacatgtatgcctagagcaggtgcggtggctcgtgcctgtaatcctagcactttgggaggtcaaggctggcggatcacttgaagtcaggagttcgagaccagcctggccaacatggtgaaacccccatctctactaaaaatacaaaaatcagtctggtgtggtggcacgtgcctgtaatcccagctacctgggaggctgaggtgggaggatcgcttgaacccaggaggtagagattgcagtgagccgagatctcgtcactgcactccagcctgggtgacagggtgatgccctgtttcaaacaaaaacaaaaacgaaaacaaaacacgtatgtgtaattgcatgtgtgctaaatgatattattctttctggtttgcactttgtctatgagcttatttttaatttaatttaaatttattttttttgagacagagtctcgtcctgtcagccaggctggaatgcagtggtgtgatctcggctcagtgcaatctctgcgtcccgggttcaagtgattcttctgcctcagcctcctgagtagctgggactacaggcgggcgccaccatgctcagctaatttttgtatttttagtagagatggggtttcagcatgttggccaggatggtctcgatctcttgacctcgtgatccacccacctcggcctcccaaagtgctgggattacaggcacgagccaccaggcctggctttgtctatgagctttaaaatgaacaaatacatcctgtgctttaacgatttaattccatgtatgtggggtgatatctattcattaaatgtgaagttttattggaatcaaaagggcgtaaatagcttaatttttccaatccacaacagtaactcatattgtcttgcaaggtatcaggataatagttctagctgttctcttcttccatgacctcagaaaatgaatgttttgtttctctttctttttgttataaaatgagggaaaaggagaaagttttaagaattccttcttccgccaggcgccgtggctcacgcctgtaatcctagcactttgggaggccgaggcaggcggatcatgaggtcaggagttcgagaccagcctggccaacatggtgaaaccccgtctgtactaaaaatacaaaaattagcagggcatggtggcgtgtgcctgtaatcccagctacttgggaagctgaggcaggagaattgcttgaacccgggaggcggaggttgcagtgagcagagatcgcaccattgcactccagcctgggtgacagagcaagactccatttcaaaaaaaaaaaaaaagaaaaaagaaattcttcctctttatctttcgcctccttctcttcctccccttccttttcctcctcctcctcctcctcctctttcttctgctataaaatgcgtgactgaaccatgcctctctcatcaccttctacacacccccttctctcccaagagtgattgacggccagaacctaatgcccctgctggaaggaagggcgtcccactccgaccacgagttcctcttccactactgtggggtctatctgcacacggtcaggtggcatcagaaggactgtaagtatgaaggctgtggacacgtggaaagacgataagggcccggttccggtctccttcgtctcctggcggaagctgcaccatgtgcagatattgcccagctatgatggttctttttcgctgagaaagccacataaacagtgcactgcagtaggattttattttattttattttattttgagatagggtctcactctgtcacccaggttggagtacagtggcgcaatctcggctcaccacaacctccacctcccaggttcaagtgagtctcctgcctcagcctcctgagtaactgggactacaggcacctaccaccatgactagttaatttttgtatttttagtagagatggggtttcaccatgttggccaggctggtctcgaactcctgacctcaggcgatctgcccacctcagcctcccaaagtgctgggattacaggcgtgagccaccgtgcctggcctgcagtaggattttagagagatgtgtttgtgagagagatttgtgcccaaagggttttattttaaatttttaaaatatttataaaatagagacaagatcttactatgtggcccaggctggtctcgaactgctgagctcaagtgatcctctctctttggcctcccacaggtgtgacccaccacagccgatccactcaaagcattttaacttagggaggtgagtgctgacacagacaaaccaatgccattgcaatattttcatgacttagatttcccgagagaaggggatatgccctaccacacaggttcacggtgggaagcaccagggcttggcttggaagcagaggcaggaaggaatgaggagcccaagcaacagcctttattattaggctttccaagggaaaggtcaggcagggcagggtgaacagcttcacactggtagtttgagtaattacagtaagtttggagcaacagagactgcccctagctgcctggtacccggtgctgggttgatttaggacagagaaaatatcagcttactgtgtgagagttagataaaggaggtggatgcttgcataggtagggtgtgttcctaagtgagttgttactatttgtattagtccattctcacgttgctaataaagacatactcaagactgggtaatttataaaggaaaaagtggtttaatggactcacagttccacatggctggggaggcctcacaatcatggtggaaggcacatcttacatggtggaaagcaagagagaatgagagccaagcgaaaagggaaatgccttataaaaccatcagatctcgtgagacttattccttaccatgggaacagtatggcagaaactgcccccatattcaattatctccacttggctctgcccttgacatatggggattattacaactcaaggtgagattagggtggggacagagccaaaccatatcgctatttttaggaatcagctagtcctgggaggagcagtctttccccaagtctatgaggcccctcaagctgtcaaaatactagcctggcacagtggctcacagttgtaatctcagcacttcaggaggccaaggtaggaggattatttgagcccaggagtttgatatcagcctgggcaacattgcaagaccctgtccctacaaagaaaaaaaaaagaattagccaggtatggtggcatacaactgtagtccagctactcaggaggctgagtgggaagtttgaggctgcagttggcaatgatcgtgccactgtactccagcctgggcaacaaagtgagacactgtctcaaaaaaaaaaaaaagtcaaaacattataggatacagaaaattaagacaacatgattaatgtgtgtgtgtaagtatgcattagcttgtgtgaatgtatacatgagagagagaacaagagagaaagagagactatgaatacccacagcttagggatgactgaagtaattattctagcaacgaggagtaaattcttcaacatgacctgccgggtggttgcttatctccaccttccttcctttctaacatcctagtgattgtttctgtcccacattcgtgctatggaagtcatgcaaacaaatataaattaacaaatagcatcgtttgccttagacctgtaaagaaaggtcttttggagtcattgcatgaaattccagaattcttacttggttggatttaactttatttgcaggaggaattttctctgatgggatcagtcacttgtggtgtgatgtatcttcattttgatgtggatagtcccacataaaacaattaaaaaaacaaaaataagtaaataaaaatctatgtttttaagattctatatgagtgcaggacatgatcaatgataaataaaacagccccgtaaacagcacaagcctcccaaatttaactatagaggattatacagtagaattttttgttattattttttctcatcataatttcagaagttgggagcatggggctgacacagtgctcagtgccacggtcatgggaccagggttctttttttctacttggccacctctgacatgctagctttcattcttgtgcatctcacctcatggttgcaaagtggctgcagttcctccaagcatcacacctgcactccatgcagtaaggagggaaaaaaccaaaggcggtaaagaatccagttagatgatttgatcctattttagtaggaaagcacagcttctctgcaagaccccaccagtagacttcggtataatcctcatttaccagaggctggggaatgcttatattttctatctaaaattgatctctgcagccaggcatggtggcacatgcctgtaaatccagctactcgggaggctgaggtgggagaatcacttgaacccaggaggcagaggttgcagtgagctgagatgttgccactgcactccagcctgggcgacagagtgagaccctgcctcaaaataaataaataagtaaataataaaaaatgaaaaataaaattgatctctgaaaatagatttggtaaccatttcatatcagaagaaagaagaaaggaagggagggagggaggaaggaaaggaaggaaggaaaggaaggaaggaaggaaggggaagggaagggaaggaagggaagtaaaggaaggaggaaaggagggagcgagggagggagagaaggaaggagggaaagaaagaaaagaagaaaacagaaatggaggaaaaaaggaaggaaagaagagagtgagaaagagggagggaggaagggaagaggagggagggagagacagaagagggagggagaaaaggataaagaatgattaactttgccaaattacttttgtcaatttcagatgtgaaagtggcatttagccttggatcatttttaattttgtttgtacctaatcagattgaggtagaattttaatttggtattcccagaattaccctattcccatctgggtcatcattattatctccaaatattctcatgacaagatttctaaaaatgtctgcaagtttgcagtgaaattgtgcattgttcttagagttgaagaaatgctactgttgctgtgtaatgctgtgcagaagagtattatcaatcactagaaaaagcttttgagaaaaacatctttaacgaaaagagtcctaaaatcaccacaaagatggtatcatacataatgcaacttgttttttaggtgcaactgtgtggaaagctcattatgtgactcctaaattctaccctgaaggaacaggtgcctgctatgggagtggaatatgttcatgttcgggggatgtaacctaccacgacccaccactcctctttgacatctcaagagacccttcagaagcccttccactgaaccctgacaatgagccattatttgactccgtgatcaaaaagatggaggcagccataagagagcatcgtaggacactaacacctgtcccacagcagttctctgtgttcaacacaatttggaaaccatggctgcagccttgctgtgggaccttccccttctgtgggtgtgacaaggaagatgacatccttcccatggctccctgagaccatgcggaccacgtgttacccaccacaaacttactgttacaatggtcataggagcagagctcacctgactgattcattccatttgggataaaaactgatggcccaacccattgttttatcctcagaaatcagttctttcaagagctcggtgaaattaaagtgggcccatataacagtgaacctggaggggagcatttgttgtataatttttttctagtatataattgtgccattgcccaaggaaaagagcaaatcaaggtgacttcagcagattcttgtagagcttttgttcctagaattcatggaagcatcaggtccaatgtcataagttagaaacttctgcttgcagattctatacccaggcatgctagctttctaataaatcatgataagtacttaattttttcatgaagcagagggtcacataaaacttgaagtagtgctgttatagtcagtttgacttcttgattttctctctttccttcttttctcttcctgtccgatacgcatctggttatgagaaaaaatgctgggctgaagttcttgactttgcttcctcgtagctatatcatcgtggaaatgtctctgtgatttggtttcttcatgtgtaaaataaggaaaaccagtgtctacttcacagagtagctatgaggattacatgcattaattaatgtgaaattgccttgtgtagaataagcagtcaataaatgttattattacaaatgttgttgtaagcatcatcaattgcagttaatcatgattccttaaacacaaaataagaaaaatggcaaagaagagtcaacatttaagaaaaaataaagaaacatggctaaaacaattatttaattgaagaaaggcatttggcaatacacataggaagtaattcaaagcaggataaacaaacataaatccaaaatttgaagcatttgtgactgcagactacaaaagacaaagaaaagatctacagatggatgcagggcaggtgagccccaaattggggcttagcctgggagggttcttggcttccctcaggaaataattcaagagtaagccagtggtggaagcaacagctttatggagaaggtagtgtcacagttctgtgaccgctcctgcagagaacaggagctcagggcactgctgcagtcatatttatacccacttttaattgcatgcagattaatgggcagtttatgcagaaatttctaggaaaagggtggtaacttctgagtgctcaggtcattgccatagaagaggccagtaatgcccagatgttgccatggcaatggtaaactgacatggcatgctgttaggcatgtcttatggaatgctgcttccatgttttagctagtcctcagtttggtcctctgtctgcttctgcttcttcttcttaccattcctgggctcaagcaatccttctgccttggcctcccaaagtgctgggattacaggtgtgagccaccacatgtggccaacaatgaatgttctttattttattatactttatattttgagatagagtctcactctgtcagccaggctggagtgcagtggaggcgatctcagctcacggaaacctctgcctcctgggttcaagtgattctcctgcctcagcctcctgagtagctgggattacaggcacacaccactacaaccagctaatttttgtatttttagtagagacaggatttaaccatgttgacgaggctggtctcgaactcctgacctcaagccatccacctgcatcagcctcccaaagtgctgggattataggcgtgagccaccgtgccagcaacaatgaatgttcttaatatcaccagcctgtgcacttaaacatgatttaaaatggtaaattttgttatgtgttattttaccataattaattttttatttttatttttttgagatggaatttccctctgtcgcccaggctggagtgcagtgggagatcttttctcaaaaacaaaacaaaaccccaaaaaaagaccgaacaaacaaatgcaataacaacatcttttgcaatttttgaagtttgaagattacttatttcactcagagctcccttgtattacttgtctttaatgctgttctcaaatttgtgtgtgtgtgtgtggaggggggggcagctagcaggtcctacatcaccccaaatccatgattttctctttattcaattctgcagtggtgcgatctcggctcactgcaacctccgcctcctgggttcaagcgattctccttcctcagcctccccagtagctgggattacaggcgcccgccaccacacccagctaattttttgtatttttaagtagagacagggtttctctatgttggccaggctggtctcgaactcctgacctcaggcgatccagccgcctcggcctcccaaagtgctgggattacagtcgtgagccaccgcacccgcccccattctgctatttcttatccctctttgcattgcagccacactgcaatgtaaatgaacctttgacctaaatgaaccaattaattatgcccccacttcactaatgggccactagagggcgttagaaaaacatttctcaactactcggtcaatgcgttcaagcatgccacaggtgttcttgctagagacttgtcattgatgttttcttgagccattagaaggaaatggccatgaggaaaagactcggtttgctttatgttaatccaggggatatgatggtagataggtaccaaccagacatgtccatttcagacagtcaaagtagccaatctgtcctccacaattcagcatttttagagaaataaaaaatggtgctgaaacatgcagagtctaaaactgaatgtctgcttttcaagttctttctaattattggctagggaaaaatcagtgtcacttaacttctctgtagtgcaatgtctcaactttaaaatgactacaatagcaaatgcttcatagagttgctgcaaagattacatagataaatatgcgaaaacacaagaggctggaacgagcactttaagatgacagtaattttattttattacaagaaagactgaggttgaattttcttaacccagaacttagattaggaagaagtggtcattaaaatataccatgcattattacttattatggtcaccattctgtgcaatagatctctaagcttattgctcctgggaggggaaagatttattgacttgcctgatgtaatcattccacattgtgaacatatatcaaagcattccatggtactatatatataatatatataatattttatataaaatattatatataatatatataatattatatataaaatattatatatataatatatataatattatatataaaatattatatatataatattatataatatatattatatataatattatatattttatataaaatattatatatatattatatataaaatattatatataatatatataaaatattatatataatattatatataaaatattatataaaatatatataatatatatatattatatatattatatataatattatatataatatatataatatatatatattatatatataaaatattatatataatattatatattatatatatatattatatatataaaatattatatataatattatatataatatatatattatatatataaaatattatatataatattatatataaaatatatataatatatataatattatatataaaatatatataatatatataatattatatataaaatatatataatatatataatatattatatataatattatatataaaatattatatataatgttatatataaaatattatatataatgttatatataaaatattatatataatatatataaaatttatcaattaaaaataaaaataaaatgctgacaaaataagaggtgttaaatgaatgtataagaaacatgaggtagctgaagtaggagtcttactcaaaccatctgccctgatctgtctatcatcccatgctgggacatgaaaaggcacatattcagaggactgggggaattgagagagagtgaaggacagacagagtcttcatcagggacgctcccacatgggaagcctcctaccatgaaccttaaagacgtgagttctggaaggtgtctgagaagagattttctgtggttttgccagagagctggcaacgaggtgatgggagcaaacccttccttcattattatattttccaaaactcacagcattattttggagaattgttaaggtagtaggagggagatttaagaaatagccccagagtgtctttgtgtttgctgccctgcatgtttgccaggaagaacatattcctcaggtattagtctcgtgctgctgataaagacatacccaagactgggtaatttataaaggaaagaggtttaatggactcacagttccacatcactggggaggcctcacaatcatggcaggaggcaaaaggcacatctcacatggtggcaggcaagagagaaaaaagagccaagtgaaacctcttataaaaccatcagatctcatgaggcttactcactaccatgagaacagtggaaaccacccccatgattcaattatctttcactgggttcctcctgcaacacgtggcaattatgggagctacagttgaagatgagctttggatggggacacagtcaaaccatatcacctgaggtatggagagactgaagaaaatgaatgtgccatttttgatctttacagagggtttcaaatttgcaaatgctcaaaaatgttatccctcaaagacctttgaggaaaaagttagttgattgactccagcaaaatggaatgtaatacaagaaaggcgagagtagacaagcacagtggctcatgcctgtaaccacagcattttgggaggctgaggtgggaggatcgcttgggtccaggagttcaagaccagcctggacaacatagtgcaatctcatctttactaaaaattcgtttaaaattgctgagtgtttactaaaaatttgtttaaaattgctgagtggcacatgcctgtagtcccagctactcagaaggctgaggtgggaggatcacttgagcccaggacattgaagctgcagtgagctatgactacactactgcactccagcctgggtgacagagcaagaccctgtctcaaaatactactactactactactaataataataataaaaagaagagagtacacaggaagcagtgctgaataaataaatgtataaaacaaagtctgaatgtgttagtgcacagttgtgaaaataatctggaattaacatttcacatgggaggtaattgaaagagcagagaagaaagagagaatgagcatatgttcatgtttttgtttcgtctgggaagaagacataggtaatgactatctttatatttgatagaaaatataagcttaaatacgtgtgctgacaggtgaaaggtggttaccaccagaaaactagaaaagatgtgtacaagtttcagagccttaatgggaaatgcgtggattgaagaaaacctgattcatgcaatcagaggtgggtgggaaagaattacaccgaagaagcagaaaatctgatatgtgtaaaaaagggaaaataatataaagtgaaactgcaggactcaatccaaatataaccatgatcataataaacatggatggattaaaattcctttaaaaaagataggctttctgaatgggaaaataaacataaaatccggacatacggtagtgtaggaggcagcttaattaaaaacaaacaaaatgttgaaaataaatggatgcatttgatatgattctgttccactatccaatctaagtaatggtcaattattttatagattgttcttcagtttttttttttttttttgagacagagtcttcctttatccctcaggccggagtgcagtggtgcgatcttggctcactgcaacctctgcctcccaggttcaagcaattctcatgcctcagcctccacaattgctgggagtagaggcacctgccaccacgcccggctagtttttgtatttttagtagagacggggtttcaccttgttggccaggctggtctcgaactcctgatgtcaggtgatccgcccgcctcagcctcccaaagtgctggaattacaggcttgagccactgtgcccagccttcagtttggttttgtccagtgttttctcatgattagactgaggttatgcatttttggcaaaaaaatcatcagaattgatgtaagttttcagtgtgtcatgttacggagtgcatgatgtctgtatgtcctgtcctggtgatgttaaatttcatcacctggattaagtggtgtctgttggaattctccactgtgaaattattattttttctgatccaggaaaggttaagcaagagtctggcaccattttaagtctaataagaaacatttactacctgatttctctgaagcctgctacctgcgggctacatgtgcataataaaaactttggtctcctcaacgccttatcctcacccagacatttcctttctactaattacaggtctttaatcagaaaatcctggaatccacctacgacctggaagttcctcactttgaatggaatcccacctttctggactaagccaatgtacatctcacatgtgtcgattgatgtctcctgtccccgtaaattgtataaagccaagctgtcacccaaccaccttgggcacttgttctcaggacctccttggggctgtgtcgtgagccattggttaaatgaataactcttttcaaatattttacagagtttgactcttttcatggacattaattggtgccctacacgtggggcctcagaaaagactcagaatccttgacgcagttgcccgaacccggagctaagttacccgcagggccattggaagccctccctggctttaggtttctcctccagtggaaccggtgagtcctctgcagctctggaccttccatttggttgatggtccttggttcattctgagctgtttttctacctcctttttatttttctcctaggaagttgttgtataggatcctactttaggtttggtggtgcattctaaatggtcttctccactgcccttttccccccaaattaatgtcgattggcctgtgagtacatttgcgtgagagactgaactgccacttttgtggcataattttgaattgccaaacgagaggctgacctcctcagcttggaaaagaaagggagttttgctcctcctagccaaaaaccacccctgggtggtaggggttgagtgggagtctctgggggattgactcctgccatgatgtgcagtgaccctacagggaaccacacaacaaaattaattttaagaggctcatccaggagacaggtgtaagagctgatcacttgctatgttgagccctgtcagaggtctagacctctggagagagaaactcagacacgtgaaagggtagaaagactcagtggtgacacacagtgtagtccctctcacagccagcacacttcaatccaccctactaaaacccaggccacagtttagttcctcattttaaaataaaagtgggagacatagcatgtaaggatgaggaaaggcggagagagcgacccccatttgggcaccccttttggttctctggttcctctacttgcaagtatttgtgtaagcgggaaaagcttgagggcatgccaggtcaaacaagaagcttcctgttacatattatgtctgtgcttgttcacactttaaactgctgcacacattacaccagagaaaattccagcccaaaggtcaacctgcaaccaatcagttcctaagtcctctattttgctattttcttttctgcctactttaaatcttctgtttactttttgttcttttcttttcttttctttttctttttttttttttttgagacagagtcttgctctgtcacccaggctggagtgcaatggcgctatctactgcagcctctgccttccaggttcaagcgattctcctgcctcagcctccccagtagctgggattacagacgtgcgccaccacgtctacgtaatttttgtatttttagtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactggtgagtttgtgttgatatctcttgctagagttctgaagtaaaagctataggatctttgtgtgagtgtgcatgcgtatttagatgtgtttatgtacatgcacatatgtgtgcacatatacattttttacgtgctttagccctgaagtgtcaaattggcttcaagtcaaagagtactcataaattaaataataagccaaaacgcttttcaagttcacgtgacttacataaatctttaataaataagctggctttaaaattattggtacgatagtattagaaatatcttaaaaattgtcagcatacatgtttgtttgcatttactgatcaagcagtttcatatttacctctgacagatattataaggtgtcaaaatttggcataaggcttacaaaactataaacccagcaacccagcatgaaacacaataatctttgtttctgtactttttgagaaataagacgtttaatgttattagtgtagtaaaaagagctaaatcccaagttatcagtaaaatatatatatatttaaaatttttgcttaggcaaacacagaaaattcatagactataaaaatggttaacagggaaataactttaaatgatgactatcagagttttcacagataatctaggtaaaagattttataaaattaattaggtaaatgtaatgaaacaaatgcctgtaaataaatataatttagaatctaaagttaaataatagatattcactaaatgtctgggccattttcaatttaaataaattgtattatagaaaaacttttctaaaaaatatgttcttattcaaagctaagttattttcatctaattccatgtttatttatttatattttttgagatggagcctcgctctgtctcccaggctggagtgcaatggtgcagtctcagctcactgcaacctctgcctcccaggttcaagcgattctcctgcctcagcctcccttgtagctgggattacaggtgcccaccaccatgcctggctaatttttgtaattttagtagagataggggtcttgccatgttggccaggctggtctcgaactcctaacctcaggtgatccacccacctaagcctcccaaagtgctgggataacaggtgcaagccaccgcacccggccagattctaggtttatttaagggttatttatgaaatatggtaaaaggaaccaagaaacaagagatgtaaagaaagttaggctgcgtgcattgggtcacacctgtaatcccagcactttgggaggctgaggcaggcggatcatgaggtcaggagtttgagaccagcctgaccaacacagtgaaaccccacctctactaaaaatataaaaattagtcaggcatggtggcatgtgcctgtaatcccagctactcaggaggctgaggtaggagaattgcttgcacccgggaggcagaggttgcagtgagccaagatcgtgccactgcactccaggctgggtgacagagcgagactactccatctcaaaaaaaaagaagaagaaagttacaaggaggtatttttggtaagaaatgttaaaagaaaaataattttgtatgagaaagaatcttgttgtttaagagagatgtttaggacagaacagaaaatccaagcaggttgtatatggtctgtgcaagtcataatacagtctgtaaaaaaggaattcaaaaaaatttttatgtaattaagtttgctataactaaaaggaaattataatcattctaggtattggacttcaataataaaaatacagtaatgcaaaaggagatcattggttagaacaagattttcttaaaatactgatgtactcagtgaaattgcaagaagttttttatttttgaattccataatctcttcttgaaattcttcagatggacatcctaggggttccacttctgctgcatcctgcttgcctcagagctttccctcttttgaaaaggcctgggatggtaactctctccttcaacttttgctggctcccgtaattttttaaaaattaatagtctaaaggaagagagagaatttttgaaaacaggcaagtgaaaaatgttataggatgtgcctctatctgtgtgtctgtctataagtttatttattgtctgtttgtttgattgatttgtttattttggagacagggtctcactctgtcacccaggctggagcgcagtggtgtgatcttggttcactgttcccttgagcactgggctcaagggatcctcctgcctcacctcagccatccatgtagctggaaccacaggtgcatactatctcgcccagctaattttttgtattttttatgtagagatggggttttgccatgttggccaggctggtctcagtcctgagctcaagcgatccacccgtcttggcctcctaaagtgctaggattacaggcgtgtggcaccatgcctggccttgtctgtaagtttctatctgtcatgaggaagtaatatttcagtaccaaattatatgaaagagctctaatcaaatggcttaaagaaaagtaagtgcttatcagacaaccaaaagctagctcagatgcttttaattgacattcctttagtaatctttggtaagactaatttggtaaatttaatttcaaaatcctgtccagtggtttaaaatcttagagtcacgttagatgggactgttcccctgaccttgacccccttcgtgggcaggaactggagtggctcatgttactcagcctgcagtttgtggacagctatgtgttaacagctcagtgaagggtcaaggtgacagccttctgcatctgtccttttggacaccgacttcttgtttggtgtccaagaatcatcaggtcacacaaactgaaagatgatgaatgtggaggactttattgagcagtggaagtggctcttggtggaagaggagctggaaaggggatggtgtgtgaagaaggtgatgtttctctgaagcctagccttctctggctgggctcccctccaaaaccacaccgtctgaagttagtcatgtttatctgtagtctccaatgctcagttacttctctgctcgccactcagtagcttgtatccctgccggtcagctgcttgtgttgcttttttctttttctttttcgtttttcttcctgccagctggtctggtccttatgggcacaggatagggggcagggcaggccaaaaaggcaatcatctgggcagagaaacgaggtcagctgctttcactagggccgagcttccagacttgaggttgtagtttagccgggagcccagccatcctgtatcaatgttagattaaattaggcaatcctaggttttgcactggaaattagggttactgggagttggaatagtaggagagtaagatgtatttttggtgaggtttataaaaacacaaagatgtggtttttgccaaagaaaatgtaatgtttagaggctatttaaaggtcactttaaaataaatggaaaattatgtagataaaactcattggagaaagagaaaaataaagaggtggggaatgagaaacctttgacttttgggtggccacgtggtcacacatggtaatgaagtggcatcattttctggggtaaatacccgagattcattgtctcatggccacagaaatcgaggacgtggacacacagaatgaggttgagagcagaagtttagtaggcaaaagaaagagaagagctctctgcagcagagcggggtcctggagaagtgggttgctgcttctttgctgaaatgcagcaagttttatagatgagcttgaggaggcagtgtatgatttacataggacgcaaaagattggttggaccaggtgtaccattttcatagggcatgtaaagctggttaggactagatgtgtcatttgcatagggcatgaaaagctgggctaatcttttttttttttttttttgagatagaattttgctcttgttgcccaggctggagtgcaatggcgccatctcggctcactgcaacctccacctcccgggttcaagtgattctcctgcctcagcctcctgagtagctgggattacaggtgcctgccaccacacctggctgatttcgtacttttagtacagatggggtttctccatgttggtcaggctggtctcaaactcctgacctcaggtgatctgcccacctcggtgcctaatcttttattatgcagatggactctttacctggctagtgccatgtcgcctgttttttttgtttgttttgttttgttttgttttttgagacggagtttcactcattttgcccaggctggggtgcagtggcgtgatcttggcctaatgcaacctctgcctcccgagttcaagcaattctcctgcctcagcctcctgagtagctgggattacaggcatgtgccaccacgcctggctaatttttgtatttttttaagtagagacggggtttcaccatgttggccaggctggtctcgaactcctaacctcagatgatccgcccgcctcggcctcccagagtgctgagattacaggcgtgagccactgcgcctggcctctggttttttactgtacacgtggtgacaaagaaaagggaagacggagcctccatgttgaacatacctggcttccaggtagccctttcccattggcacagctgccagcatttacccattcaagcttccagcttgcttattatctatgcctgcagctctattttccaggctgctctttgttaaaaagaaatgatttgggggctcctttttaaaaagggaaattctgccaaggactcttttaccctcactatctgcctgaataatttctttctagttcctctatcagtaaggagatgcagctggcttgtcttcagtcactaaaggtcaaagccaccagaggaatttagagatggatcctactcatagtcccagggaatttcgttcactggatatatagcaaatgcaaattaataaggaaaaagtgaactattcaatcccttgcttactgcctctgtagttgctaaaatgaaagtaaaagagtgctgccttgggcgtgaaggcagcaccaagctcagatgtgggtctgtctcagatcaggccagtgacctcaaagcttcctacacaaggaaaaattaagccacgtcaaccaaaagttacctctgagacctgtgattaccaagaagatagacatgtggaggaagggcaaaaccaagtaactattaaacccagagggtatttacagggctgttcaatcttttggcttccctgggccacactggaagaaaaattgtcttgggccatgcataaaatacacaaacactaatgatagctgatgagaaaaaaaaaaggcaagaaaatgtcgtaacattttcagaaagtttacacatttgtgttgggccacattcaaagctgtcctaagccacgtgcggcccgcgggccgtggattggacaagcttgaaaaggaattggttcatcttctagattggtatcgtcagcttcctgagttcccttttctaaaatgggttgtaagaatgactactttaagaacagtatgtttaatttttttttttttgagaaagggtctcattctgtcacccagactggagtgcagtggcatgatctcagctcatcgcaacctccacctcctgggttcaagtaattctcccacctcagcctcctgagaagctgggattacaggcacacgccaccatgcccggctaatttttctattttttggtagagatggaatttcaccatgttggccagactactcttgaactcctgacctcaggtgatctgcccaccttggcctcccaaagtgctgggattacaggcgtgatccactctgcccaccgatatgcttaatttttaaatgccacagaaagaaagagcatgtttgggctggtgcagggcccgcagctcactcactattaaacacttgctgatgagtgtatgggacccagatgcacaggaagtttttcctgaggaaatggccagcctggtggactaggtaaacaccactacaaggtctgtttatcctgaaaaggggactgcccagccctccctataaaatgccaagtggagcaccctagataaagcagctgatgtgcttcatatgcaagccatgtgggattggcttaatgatgaccgggatattcaccagctgaatatgcccattacccaatgtattagtccgttttcatgctgctgataaagacatacccgagattgggcaatttacaaaagaaagaggggtaattagacttacagttccacgtggtgggggaagcctcacgatcatggtggagggcagggaggaacaagtcacatcttacatggatggtggcaggcaaagaaagagagccaagcgaaaggagtttctccttgtaaaaccatcagatctcgtgagactcattcactaccacaagaataatatggaggaaactgccaccagaattcaattatctcccaccaggtccctcccacaacaatgggaattatgggagatacaattcaagatgagctttgggtgtggacacagtcaaactatatcaccgaggtcatagtgtgaaaggaaaataaatctcaggaccccaaaatcactaagccaagggaaaagtcaagctgggaactgtgtcaggcaagcctgcctcccatttgattcttaaataagacagctacaaagataagaagctacatacccccctcacaatttgtgcttaaggaaattccttgtggacaaaggacagacggaactcaaagtcatccttccaaggctcccctgagacaaatgcttatctgataacttcctctgcctcattgcttatgtaaaagtacagattcacggagccagcctaaattgtgtattcagtggaaagctgatcaaggactcaaaagaatgtaaccttttgtctcgtgtctacttctaatctgaaagctcccacttcaagttgtcctgaattactgaactgagcccatgtatgtcttacacatattgattgatgtctcatgtctccctaaaatatataaaagcaagctgtgccctgaacaccttgggcacatgtcgtcaggacttcctgaggctgtgtcacaggtgcacgttctcaaccttggtaaaataaactttctaaattgactgagacctgtctcagatattttgggttcgcaatagattctcagtgtattaatgatgttaggtgaagaactgtgaagctcataaatttggaaaggaaaggtttatttctataaatgttgtggttcaagggtccccttctacaagagcaccccaggtgacattactcttgcagaatcaaacaatggtttgagaaaccttatcaaatttgcagttgtagctttccctcatgggtcttacagatgctaccaaaagactagggtgtcaacgagaagagacaaactgtaaatttttttaagaggtttattctgagccaaatatgagtgaccatggccgcccgtgacgcagacttcaggagatcctgagaacatgcgcccaatgtggtctgcgtacagcttggttttctacattttagggagacatgagatatcgatcaatacatgtaagacgtacattgtttccattcaaaaaaggtgagataactcaaagtgggggattccagctcatggatggacaagacacagaaggttgcattcttttcggtctttgatcagaatacacaatttacatgtgacggaggttggggggtgggggtggtgggtagaggaatagtgactgatgcctgttcagtgaatctgcaagtttgcgtaaacaatagggcaggggaatctatcagatatgcatttgtctcaggtgagcagagagggctgactttcacttctgtctctcctttgacccacacctgtgaagataagccaaggtgaaattgaacagaactgttttagggtaaagatcttgaggtccacaaaaaatttctttgtgggcaaattatgaaagaggtatgtagctttttgttttgttttgtttgtttgtttgtttgtttttgtctccatagctgtcttatttaggagaaaatgggaggcaggtttttctgatgcagttcccagcttgccttttccccttggcttggggattttggtttcctttcactaattaacaaacaaaattaataaattaacaaacaaaaacagggaagggaaaagtgagtcaaagggctcatgccagaagggtggaaatctttagataattattttgttattattattaatttttctttttttgagatggagtttcgctcttgttgcccaggctgacatgcaatggtgccatcttggctcactgcaaccccacctcccaggttcaagtgattctcctgcctcaacctcctgagtagctgggattacaggcacctgccaccacgcccagctaatttttttgtatttttagtagagacgaagtttcacaatgttgggcaggctggaatctttagataattgttaagaaataaaagaaaaggaaaattgatggagttaaaacaaaagactttacaacatgatcaaaggttgggtgggccacagggagccccaactggtcccccaacatgaaggggccccatgccagttttcttcatttgcctcagattggagaagtttaagaaaaattgaggctgggcatggtggctcaagcctgtaatcccagaactttgggaggccaaggcaggcggatcatctgaggtcaggagttcgagaccaggctggccaacatggtgaaaccccgtctctactaaaaatacagaaaaatttgctgggcgtcgtggcacgcacctgtaatcccagctactcaggaggctgaggcaggagaatcgcttgaacccaggaggcagaggttgcagtgagcagagatcatgccattgcactccagcctgggcaacaagagcgaaactctgtctcaaaaaaaaaaaaaaaaagttttagagcaggaatgaaaagaaggaaagtacacttggaagatggccaagtagctgacctaagagatcaagtgtatggttgacctttagacttggggttttataggttggcatgcttctggagtcttgtgtcccttctccgctgagtcttcccttggggttgggctgtccacatgcacagtggcctgccagcacttgggaggggagcatgcgcagtgtgtttactggagttggacgcatgctcacttgaggcgttcttcccttaccagctgaatgttcctagaaggttatagaccagttaaactccaccgttttgcttctcagtgtgcatgcttgagcccactcactcacctcctgagatcgtattgggaaactgctgaccaccagttttaggtgttttctatttactgggagacggcctttccctggtgctgactgtgaccaattattattttagagagacagtttaataaccgcctgatgctcgcctgacattcctggtggggctggggagagcctttcctgccttgctcatgcctgactagctacctactgtaacaataactgaactctttctaccgatttccagtgagaaaatctatgcatctatctatgacctgcaagcccccactttgaagtgtgtcacctttcctggctgaaccaatgtccatcttacatgtattgaggggtgtcttatgtctccctaaaatgcataaagccaatctgtaactcaacaaccctgagcacatgttctcaggatctcctgagggctgtgctatgggccagtagtcactcatatttggctcagaataaatatcttagaatagtttacagagtttgacccttttcatcagcagaggcatacactcttgctatgggatgttaaccgaagctaatggaaataatggtgtccaaaagagttccgtgatgaaacgtaaatggttcatgtaggacctgctacctggggaatgcaaagataatatacaaggagggagcttctttttcctcttcagactgactctgtaactgtgagaagatttttgccttccaaagttattagtgtgttcatttttatctcttaggaaaaaagtggcaaagttggagatggtgtacactttcctttattgcttgactgaggttaaaaatttggccaggcatggtggctcactcctgtaatcatagcattttgagagcccaaggccaaggatagcttgagccaagaagttcaagaccagcctgggcagcatagcgagaccttgtctctacaaaaaataaaaaaattagctgggtgtggtggtgaacacctgtaatcacatctacttggggggctgaggtgggaggattgcttgagctcaggagctggaggttgcagtgagccaagattataccactgcactccagcctgggcaaccaagcgagatgctgtctcaaaacaacaacaacaacaaaaagaacaacaaaaaacaaaaaaaaacttgtattctattgtctcccatcagattatttttaactaattttattttaatcacttactgttgagtcacctctgagattttctattccagtggcgtccttataaaatgaagcttccttgtcaactgcacttgttataacaccgagcttctgctaagaaaaagcaaatgcataactctgtataacctatctcccatgacagggtctatgcctcgctgtatttaagcattcattttagttttcagcaatgtagtactttcacctatattttgtcaaattcaaacacttgcaatacttcatttattttttctgcatgtccttcatattttggctttgctagtccactttggccaaaaagctttgattctttaagtataggcctaaatatcctatcttaagcatgggtgtaattttcttctattaccaacagaggttcttttatagtttttgaaatcactgattaaaaagaaacagctcaaattatattctactgtaaaaatgatacattcagcctgggcacggtcagtcacatctgtaatcacaatacgttgggaggctgaggcaggaggatcacttgagtccaggagttgaggctgcagtgagctgtgatcacaccactgcactctagtgtgggtgacagtgagaccctgtctcaaaaaaaaaaaaaaaaagatacattcaaagaagtcaaaataaaacagtataaaacctatctccctgattgcagctacctttttttatgcatacgcctgcaatccttttacacctatcacacactaaaaatgttttacagttattgttattgcacacagaaggcatctaggaatgttttaaagaacctgtctctctgaagttcatcctgcttatctaacttgtctatcaaggaaattattttcttgattattattgctgagaaagactgggtgaggttgctaccccagaattagcagatgcaaatcaggaggaagtgaacaggctgcaaattagcaagttctggcatggggtgaggcaatggcagaaaatcggtttcctgggaaccatgcccaggaactagcctgacattgtgagaaagctcccaacattcataatgagttgcatattaaattccagggaagggcactgtaggtaagatggaccacatttggaaatacactttttcagacgttttatttagggagaatttctgacatgtcctccgataatttgaacttccttgatttgcagttgtacattgagagatcatttcttggtcaaaataaatgttcagcaggtgtgaatgctgtatccacaacttttttttttttttttttttgagacagtctcactctgttgcccggggtgaagtacagtggtgtgatctcagctcactgcaaactctgcctcccaaattcaagcaattctagtgcctcagcctcccgagtagctgggattacaggcatgtgccaccatgcctggctaattacaacttaatttttaaatttgggcagatttacaaaactatcaagctattaccctgcagcatccttagccctaagcttgtcactacttgtaatgtatttttattttatttatttattttttgagacagagtttcactcttgtcgcccaggctggggtgcagtggcatgattgcggctcactgcaacctccacctcctgagttcaagcgattctcttgcctcagccttccggaccacaggtgcatgccaccacgcctgggtaattttttttttttttttttttgaggtggagtttcgttcttgtcattcaggctagagtgcaatggtgtgatcttggtttactgcaacctccacctcccaggttcaagcgattttcctgcctcagcctcccaagtagctgggattacaggtgcccaccaccacacccggctaatttttgtatttttagtagagacagggtttcaccatgttggccaggctggtcttgaactcctgacctcaggtgatccacctgcctcggccttccaaagtgctgggattacaggcatgagccactgcacccagcctacctactggactttttttcggagacacactgtagtttctcaagaaagaatgcctgttcctggtcccagctgcacactcactttacagtgtgtgctgtacttggtcaagtgtattgatattgaaacacaagccagactggatggaccttggtcataaatcatggggcagctctccttcactgtcagataaaatccaaattctctattactacctccaaggtcccagcattgacgatctgttcttttcttcctgaagggacatcacccccggttctcagggtgtctcctcacaggcttcttacaaatgcctttcctcaggaatgtggctccacaatgacttttttttaattaaaaaatttgcagcctacaatcagcctcctcaattattattattattattaattgttattatcattacttgaaacagggggagagtctcactatgtggtccagactggtttcaaactccttgtctcaaaccatcgtcttgccttgacctcccacagtactgggatgacaggtgtgagcccccgcacctaagtgtcctcttaaaacccatgaagtcttttagggctgtctacttttctctatggaattcaaatcgctaagcattcatgaaagtttagataaggtggaaataaatccaacctttaggatggatgcatgaaactgctctcttttttttttttttggtagagttttgctgttgttgcccaggctggagtgcaacggcacgatctcggctcactgcaatctccgcctcccaggttcaagcgattctcctgcctcagcctcccgagtagctaggattacaggcatgtgccactacgcctggctaatattttttgtatttagtagagacagggtttcaccatattggtgggctggtcttgaactcctgacctcaggcgatctacccacttcagcctcccaaaagtgctgggattacaggcatgagccaccacatccagccaaaactgcacttaaaatccaatctttggccgggcgcagtgactcatgcctgtaatcccagcactttgggaggccaagacgggcagatcacctgaggtcaggagttcgagaccagcctgaacaacatggagaaaccccgtctctactaaaaatacataattagccgagcatggtggcacatgcctgtaatcccagctactcggaaggctgaggcaagagtatcacttgaacctgggaggcggaggttgcagtgagcccagatcgcgccactgcactccagcctgggcaacaagagcaaaactccatttcaaaaaaaaaaaaaaaaaaaaaaatctaatattgtccccaattcctacttttgggagtaaactatgcctatttcaaactattgctggacaagattgcctggtttctgcttccccttatccctcttgttcaagtcaaccagtcaggaaatataaagaatgatcaaggaaacctccaagttaacacagaaatacgtatatatggtgaatgctgtctgcagacagcttatggccccatggtactagccgtcatagcacatggcaaagttgtcctattgactctgctgtcagcccctgcgtggaagaccaaataaaggtgctgggacagaaggatgaaaaggaatcctaggataaatatctcatcttcatcgtccctgggttggataattctgagggtctgtcgttgaatctcagtgtttctgcacagcactcagcttcaatagcccagtggcaagctgcttcataagtacaacctctactggcttcctgcctttccctgtctctcttcctctttccctgaccaatgctccctcaattacctccctaataacctacttggatttaaggtttgaaaaagaaatgcggcatcattctttttgtcttaaatttttaattaaaaaaaatttttttcgagatgggatcttgctctgttgcccgggctgtagaacagtggtggaattacgatacggctcattgcagcctcaaaccctttagctgaagcaatcctcccacctcagcctcctgagtaactgggaccacaggtgtgtgccaccgtgcctggataatttttgtaaaatattttttgtagagacagggtctcactagttgcccaggctggtctcaaactcccaggctcaatcaatctgcctgtctcaacctctcaaggtgttgggattacaggcgtgagccactgcgccgggtcgcaccatcattcctattttttttttttttttttggaaatgaagttccctctgtcacccaggctggagcacagtggcgctatctcggctcactgcaacctctgcctcccgggttcaagtgattctcctgtctcagcctcctgagtagttgggattacagtcatgtgccaccacacctggctaatttttatatttttagtagagacggcgtttcgccctgttggccaggctggtctcgaactcctgggctcaagccatctgcttgcctcaactcccaaagtggtgagattccaggcatgagccaccactcctggacgaagcatcattcttaatttcaatgtctagtctagacatttaaaagaattgaacatattggatcgtatcaaaacaacatcttgttgaagagaatgaccctctccacccaacctgaaacagatggaggcagtgctgactttatctcaatcttaaacaaaatctgtttcactcaattttcttgtagacaggccgactgctttattagaaaacaggagaacattgacctttttctatgattctcttccgatcaccctaggtagaattcctttcactttctaacctgtgtctgtttcaacccaggatacattaagcttgttgtctgtgacactttattgaactttttaatagccacgactgacactgatcctctctgctgagagaggagctattctgattccattcattgtgactccaaagtctaccctggaagtcagatgctcaggtgggattttataaatattccatgaacaaatgaacttcggctttggggtaaaagagtcggttgcccatcatttgatagatccctggatattttttcataaaaaacaccctagcaggttgcttattgcaaaatgacatgtgtcatatcttctctggagctgaatattgttaagcaaaatttatattaatgagaagcaaaaaaaagtttgtttgttttgctttgcttcagcaagaattatctgttgcatcagaaatgcagggagcacttttgctctttattagcgtttttttccccagaaactctgacattactaggacacttggtcatctgtgatctgcttaaaagctctcttcagctcctggaagagtaggtggttctgattctctttcggtgagatggtttatggagccctcttcatcccataattctgaagagtaacaggcagaacgtcttattagggggcagctgaaatcgtctagggaatgtggctagggagtgtcgtcatctttacatcaaaggctatgcacagataacacgccaatcctgatttcacccatgagaaaagtgaactccaagaatttcaggaatgtagacgtgtcgatgataaacattgcatttattacaatttcactttatttcctagaagaggggacattatatttcctggccagatgctaccctttgaaagaaatgcaaactttgataaaatagacatgctatcaatttccttaggggagctttatcttcactgggtcactatacccagcatgacagtaaagtctgccatgtgtttcttgtcccactggaaaaaaatacatagaaaagctatgtacaaggactgtattaagattcatctatgtctttcagagatggcaggcaagtgccatttctgaacaatttgggtgaagtcagacacatgcaccttaccccgacaaccactcaatggacagcagaacattgcaaatcatgacctgtaataggactgtctttgacttacacagctcaggaaacaacacttggtttggtcaaaggtttgttccttttcatttcgtgttctagtgttttcttttcctgcccttatgacagttgtgtgcaatggcattattgcattaaatagacacgactgattaggtagcatgaaccatagtttagaatttggctaagtgtggctatgttactgtctgttttttctttttctttttttaggagatagggtcttgctgtgttgcccaggctggagtacagtggctattcagacatgtgattccaccactatcagcacgagagttttgacctgctgcatttgtgacttagggtggttcaccaggccttaggcagcctggtggtcttctgctcctgggaggtcaccaagctggtgctgaacgtagtgcagatacttgatcagcctagcgcaccatagcccagaacttctgggccgaagcgatcccccacctcagtctcctgagtagccgggaccacaggcaggctacttgctgtttttgtcaacataaaagggagtcagaaaaggcagaacatatcaagatcagtaaatctaggctgggcatgatggctcacacctataatcacagtgcttcatgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctggggtgggtggatcacctgagatcaggagtttgagaccagcctgaccaacatggtgaaaccccgtctctactaaaaatacaaaaattgggattccattccaagatggccaaatagaaacagctccggtctacagctcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccacttgctgcttttttttggattcctgtggataaatgttgattgaaatttgttttatttcccgaaagcttataatttactaattctcttataaaaaatccgcacgatggccgctgataatgtcactgcagaattgctacttcttctgtttgtcacccagtctccaccttgcctatcgccagcaccaacactggcctttgcagtcttcctgactttctttgttttgttctttcattccatttgctgtttccttgaggtctttctcttctcacatgggctgtgtcttgcaagtctatgtttgggttcatttttctttgcataatctgaagatttgtaaatcgtgccaaaaccagttgtcttgccaccaccaaaatgaattctgaatatgaatacaaagaggacatcctggctgggcacgggggctcactcctataatcccagcactttgggaggttggggtggggggatcacttgaggccaggagtttgagaccagcctggccaacatcatgaaaccccgtctctactaaaaatacaaaaattagccaggcgtggtgacacatgcctgtaatcccagctacttgggaggctgaggcgggagaattgcttgaacctgggaggcagatgttgtagtgagccaagattgcgccactgcactccagcctgggcaacagagcaagtctccgtttcaaaaacaaccaaaaaaccaggacatcctgtgtggtcttgtccatttcggctagtttttcctgaatatctgtcttaggtgctgttgccttcctggggtgaaggacatcgatgaccatttgttgcctctgaagaagtcagtagctcatgaccttcctgtgtagatagttactatgtcatccatgttgacagctgagggcactggcaccatcataactcactgaagactccacagcaatcctcccagttcagcctctggagtaggtggcactgcagacacataccaccacgcccggctctttttattcttttgtagagaatgggtcttgctatgttgcccaggcccatctcaaactcctgtccccaagtgatcctcctgcctcagcctcccaaagtgctggaattataggcatgagccactgcatcaagcctaatttccattttctaaacgtgtctttccgtgccagaaaacaagcacctacagacacttgtgccatctgctcagttgctttgctctaaatataaggccctgtgtcatcaggaggcaacatacgaggcatttaaacagtgcattaagaggatcaagtctaaacgtggccactaaccaaccaaaagggtttatgtttgtcaacaacagatagaaattgaatcaagagtggtgcaataattcagcaaaacgtgtgtgaacccagaaagtctgagacaggtctcagataacttagaaagtttattttgccaaggttgaggacgcgcctgtgacacagcctccggaagtcctgacaacatgtgcccaaggtggttggggcacagcttcattttgtacactttagggagacatgagacatcaatcaacatatgtaagaagtacattggttcgctttggaaaggcgggaccacttgaagtaagggctggaagacttgaagtgggagggggctttcaggtcacagacggtgagacacaaacagttgcattttttgactttctgcttagcctttccagaagaggcgatcagatatacatctatctcagtgagcagaagggtgactttgaatagaatgggaggcaggtttgccctgagcagtttccagcttgagttttcctgagtcattttgggggcccaggatatttttttttcacacatgctagcactgagtgacatagcaattggtctcctggcagcctggaaatttcagcaacagctgataagacagcgtggtgagcagccaggttctagaaagcaaagagaagtaggcatcaacaacctgggaggagcactgctttgatccccccagaatgtgccagaccattaatgaagtatcttatttccttcttaattcagcctcatgatttaggtataaacacttgtgtgagattgcccagagctgccataaaaatcaccataaacttggtggtttaagaaaacagacattcattcttccacaattctggaggctagaagttcaaaaatcaaggtgcttcctccgaggccctgggtagaatccgtccttgccaatccttgaaattccttggcttgtggacatatcactccaatctctgcctttgtcattacatgaatgtctacgctctgtgtctttaaatctctctctccttatagagagagattatagtcatatagaatttagaacccaccttcatctactatgacctcattttctcttgatggcatctttaaagaccctatttccaaataaagtctcatgtgcaggtaccaggatttaggactttaatgtaaccttcgaggaggtcataatttaaccctttgcacccttatataccaagaagagtacctgggacttggaaatgctctgtaatttgctcaggagaacacagcttaggtgttactgggctgagactggcaccctagccatgccaatcccaaatctccatgtacatcaaccctatggtgttgaagtaggaggcgcgacttgactccagaggtgggggttggacaccagaccagattgagggctagctaaaacagggcagaccaaagcagctttcagtcagacacgcccatcagtgtgccatgtcaatttaccattgccatggcaacacccaggagttaccacctctttccatggcaatgacccaataactcaacgattactacgctttccctagaaatttctgcataacccgcaccttaatctgcatgcaattaaaaatgggtatatattttgggaggccgaggcgggcagatcatttgaggtcaggagtttgagaccagcctgaccaatatggtgaaaccctgtctttactaaaaatacaaaaaaaaattagctgggtgtggtggagcatgcttgtagtctcagctactcaggaggctgaggcaggagaattgcttgaacccgggaggcagaggttgcagtgagccaagatcgtgccactgtgctccagcctgggagacagagtgaggcacggtctccaacaaggaaaaaaatacaaataaaaataaatgggtataaatatgacttcaaaaaaaatatgccctgagctgctactctctgcctgcagggtagccctgttctgcaagagcagtcacggagctataacactgtcacttcaataaagcagttttcttctacctctggtttgcccctaaattctttcccgagctaagccaagaacacttgtgggctaagccccactttgagactcacttgtcctccaggagtgtctctcaaaggtgcaaccccaggagtaacataatcatgtgtgttcgtcaatttgcaattgcaaaaatgtggaacaagcccaaatgcccatcaatcaatgagtggatacagaaattatggtatatatatgtacaatggaatattactcagccatgaaaatgaatgaattaatggcatttgcagcaacctggatgggtttggagagtaagcgaagtcagtcagaaacagaaaaccaaacatcgtatgttctcactcataagtgggagctaagctatgaggatgcaaaggcctaagagtgacacagtggactctggggactctggaggaaagggtgggaagggggtgagggataaaagactacaaattgagtgcagtgtatactgctcagtgatgggtgcaccaaaatctcacatatcaccactgaagaacttactcatgtaaccaaacaccacccgttcccccaaaacctatggaactaaaaaaaaaattagaaaattatgtgtgtttgacttatttcaatggactgatactgttgccttgtctttactaaggagtaatatgaatgtgtcaggtgaaatacaaataactgtcttaatattaactattaaacaaggatatctttttcctaagtgatttggggcaaccatattagaccttatttgtccacaaaagaattccttacaaaggctgagcatttttctgccactctttgttctaagatctctaaaacatcttcgttttctcatcactcttaggaggaggttcgttttgaatttagaataccctagaacagaatcttaggattttagcctgagaaataacttctgaaatcgttttctcaaatgctcttatatttgcagatgaagaacacagagtgtgaagacacgaagcggctttaatgagtctgcactgtaaagggagcaggaccatgaggtctgaacccaaggttgtcaaccccaaatgcaaggtccttctccctccctggctccggtccttccattttctttaaccacatggcaaggagaaggtagtagataaaagcaagctatgtacaaccaagggaacacgttcttttccacacagtggtgttcagaggtggaaagaatgttctctagggtttgacacaattggggtgaatgggaattgttcttcttgccagctaaatatctttggacatattccctaatctatctgtacttcaattgttccctctgtgaaatgcaactaaaaagtgtattaccagacttacaaagattaatggagataatatctgtaaaagactttgcacatagcgcataggcccataggtagctcttaataagtattatatttccttttctagtggttattttgaaaataccttaagattaaaattgaaagaatgtcatctatcaaaatgatacaaacctttgccattggtctaaacactccaaactcaatgcttaattaacctatcatgacccattgcatcgagaaaattaccttcacctgccttgtctatccgaggtggtcaatattttccatatgccccttaagcccttaattaacctttttccctaaatagaaagataaattatacaattcagtctgcaaatatagttacttaagggatgtctattatttcctcattctgaattatcctttaaataatttatattctttccttcgcattgaggaatacaagcctgattgagcactgcgtgtttttaatcattacatgaatttaaacactaggtggcatgctaatatagctgcctgcacagctagctccaaattcctaatatgataaatgtgtgcatttatttcatttttgtaaagatagcatacattttaactttattctcggaagaggaatttgaaaaggaaagacacctttttcaactcatattgtttgattgcatccagaaattcacctccacctactttatccatctgaggtggtcagtattttacataagctcctcaaacccttaatagctttgaaggaatggaatgcattgcctaaagtttcagacaggaataacagaaagcaaaaattagagaaacaaagacagaagggtagcgggggagagagacagaagtatcaaggtgcatcatttatcatctggagttttctaagcacatatattttaattacaactagcatgtgtgatccgtgctactcattcatcccccagagtgtgaacataaatggagaacctagaataatccaggcactggtctaaagttggagaaaagatacgtagtttcttctgtctcaagaccgtgttcggaggatgagtaaagcaacgtgaattagagttgagatgggccaacaataaataatctcaaaaggcttggctgaaagcagcacccgcacctcagatcttggctataatttagctaaggaagcagtgtatttagaagcctacttgcaatgattttttcaaatccaaatcttttatgaaatttgacttgggtggtacagggattcaagagcaaatcccaaattggatggacccacaaatggtaaagactcctagggttagggttatagggttttccttactcagatctgcaaatggcctcagaagccctgcctctggctggagcgggtttccttagcagtgttgtaaaaaaaagcgggagatacaggaagtacacattgcatggaagcacagtttgtatgggtggataccttggggtgatgttatggggcgatgattagttgcccggccacctcttggtgagggtaattgagcaatggacattttccagctgcggatggcaggatgacagtcagattctgcagaatagaaagcttggattctggttcagaaaaatcctgcctcttcaagtatgccttgtttgattttccattgcatttagacgacatgcaagtgaaacccccacttggaaaatgccaaatatccacccacatctccagcctgtatccattctttaaacagtaaagacttccttccttctttttttttttttttttctgagacagggtcttgctctgtcacccgggctgcagtgcagtgctgcaatcatctttcactgcagcctcgacctcccaggctcaagtgtcctcctgcgtcagcctcccaagcagttgggaccacaggtacgagccaccactccctcctaatttttgtatactttgtagagatggggtctcacgatgttgcccaggctggtctcaaattcctgggctcaagccatccgccctgcttggcctcccaaagtgctggaattacaggcatgagccaccatgcccagcctatttttgtttcttctaagcagaattttgatcagcaatccagattccctaactttaaccccaagagccgaatttaggtccttgccagagaaatgctatctatggtatagacttaggaaatatgcatatttaagaggaaacttttgaagaaacccactgttgctatcagtatgagtaataatgacttaagcaacctcagttcttggcatcattcctttgtggatagaaccaggtatatagtttgcaaggccgagtgcaaaatgaaaacgctcagctcttggggaaacaggtaaaagtaaaaataaaatggttatgtctgttaaagcaaactaaatatggcctgagaagtactccgtacttctatatttgagtccttgtggatgaagggtatcctagcttaataggcaaacaaaattgaaaacctaagttaatagcatgcatctgtaacaatagctgagtgttggccaatcccagcggccatacttcaaccactcatagactgctgagtgttcaaactgcgttcaaatcaggcaaacgccgagcagtaatccatttcactgtttccgtaccgcacttccgattcctgtacctctctttacctttttctttttttttttttgagacggagtctcactctgtcgccaggctggagtgcagtggtgcgatctcggctcaccgcaagctcggcctcccgggttcgtgccattctcctgcctcagcctcccgagtagctgggactacagtcccccgccatcacgcccggctaatttttttttttttttttgtatttttagtagagacggggtttcactgtgttagccaggatggtctcgatctcctgacctcgtgatccacccgtctcggcctcccaaagtgctgggattacaggcgtgagccactgcgctcggcccactttactttttttgtctataaatttgttccgaccatgaggcacccctgcagtctgtctgaatctgctgtgattctggaggctgcctgattcaatcaaatcttttctttgctcaattaaactccatcaaatttcacttgtctgaagttttcttttaacagctccttgttccaaaatgtttaagaatttcgatagggtgccagcagaacagaaggaaaaacaaccacaacaataataactttttcctctgtcctcctcagttctccagctactgctctggaaattaaactgtcaaaagaacaaaagaaaagcagaatttattaagacatgcagtgcatatacacatgtggtgaaactcagtgatgaataactcaaaagcatggttagaacttggggcgcatacaacaaatcagccaagaacaatacatttgtcaagaaggaaaaaggcaaaggaaaaaggccttttaagctcctaggagctgcaaactttgagaagacaaatacaggaggaaacaaatggaagataaaggcaaattgagtaaggtttgttatgtagattcctctaggcctgtgtctctggtaattaacagtctaagtctactttcaggcaaataggagagtgcagagagtttttttttttccccactcccttagctgacttgcttttattgtttgagttaaaaaagaacgagatcatgtcctttgcaggaacacagttggagctggaggccattatccttagcaaactagcacaggaccagaaaaccaaataccgcatgttctcacttacacataggagctgaatgatgagaacacacggacacaaagaggtgaacaacacacattggggcctttcggaaggtggagcgtgggaggagggagaggatcaggaaaaataactaatgggtatgtgaacccagaaagtctgagacaggtctcagttaacttactttcttttgccaaggttgaggacgcgccgtgacacagcctcaggaagtcctgacgacatgtgcccaaggtggttggggcacagcttcgttttatacattcagggagacatgagacatcaatcaatatatgtaagaagcacattgattcggtctagaaaggctggacagcttgaagcaaaggcaggaagactggaagcagggagggggtttccagggcacagataggtgagacacaaacagttgcattgttttgagtttctgatgagcctttccaaaggaggcgatcagatacgcatctctcagtgagcagagcggagactttgactagaatgggaggcagaggccctaagcagttcccagctggacttttccctttagcttagtgacttggagacctcaagatatattatcctttcacaggttctaagcttaatgcctgggtgatgaactaatctgtataacaaacccccatgagaggtttattctgttttcttttagcagctcttgcttctcatttgtcttcagctcaaaataacccttatgccaaagggctatcttttgggttgacctatcctgctctcccacaagagccttcagcaaagtttacagttgtcttgcagaagaccacccgggtggccaaatagtgtaatagaaaggagaggtttgtttttttattatactttaagttctagggtacatgtgcacaacgtgcaggttagttacgtatgtatacatgtgccatgctggtgtgctgcacccactaactcgtcatttacattaggtatatctcctaatgctatccctccccctccccccaccccacaacagtccccagagtgtgatgttccccttcctgtgtccaagtgttctcactgttcaattcccacctatgagtgagaacatgcggtgtttggttttttgtccttgctatagtttactgagaatgatgatttccatgttcatccatgcccctacaaaggacatgaactcatcattttttatggctgcatagtattccatggtgtatatgtgccacatgttcttaatccagtctatcattgttggacatttgggttggttccaagtctttgctattgtgaatagtgccgcaataaacatacgtgtgcatgtgtctttatagcagcatgatttatagtcttttgggtatgtacccagtaatgggatggctggatcaaatggtatttccagttctagatccctgaggaattgccacactgtcttccacaatggttgaactagtttacagtcccaccaacagtgtaaaagtgctcctatttctccacatcctctccagcacctgttgtttcctgactttttaatgattgccattctaactggtgtgagatggtatcttattgtggttttgatttgcatttctctgatggccagtgatggtgagcattttttcatgtgtcttttggctgcataaatgtcttcttttgagaagtgtctgttgatatccttcacccactttttgatggggttgtttgtttttttcttataaatttgtttgagttcattgtagattctggatattagccctttgtcagatgagtaggttgcaaaaattttctcccattttgtaggtttcctgttcactctgatggtagtttcttttgctgtgcagaagctctttagtttagttagatcctgtttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcgtgaattaatttttgtataaggtgtaaggaagggatccagtttcagctttctacatatggctagccagttttcccagcaccatttattaaatagggaatcctttccccattgcttgttttttcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggctatgcgggctcttttttggttccatatgaattttaaagtagttttttccaattctgcgaagaaagtcattggtagcttgatggggatggcattgaatctataaattaccttgggcagtatggccattttcacgatattgattcttcctacccatgagcatggaaaaaggagagttttattggtgatgtcagtttgcaaactgggtagtaagtgtccctggcataaacagaaggtgctctctctctgaagagggaaaagagagattggatctcatgcctcatagggatcatattacacaatagagtcatgcatattcagcagatttgggggagaagctatgcatatttatgaggggagctgagtgcatgcccaatgggtaaacatatatgtaacatatgtcccatgttcactttggggctatgttttagcattaaaatgaggcaggtgtggtggctcatgcctgtaatcctagcactttgggaggccaaggcaggaggatcacttgagctcagcctgggcaacagggtgaaaccacgtctctacaaaaaataaaaataaaagagccaggcatggtgacacacacctgtggtcccaactatttgggaggctaagttgggagaatcggttgagcccaggagattgaggctgcagtaagccatgactgcaccactgcactccagcctgggtgacaaagtgggactgtgtatccaaaaaaaaaaaaaaaaaaaaaaaatgagatgggatttggctcttcatatgaagaggtgaactataggacacaaagacagtttgtgtgaagcctctatgagctggtgaaacttgagtaaggtctgcagttgcttatcagaaaagaatgtgtgtatagctgctcctctgtctgaatagtagtctgggttgtcaagacttagaaggggctgggcacagtggatcatgcctgcaatcccagcactttgggaagcagatgcaggcaaattgcttgtactcaggagtttgagaacagcctgggcaacatggtgaaactccatctctacaaaaaatacacacacaaaaattagctgagcatggtggcatgaacctgtggtcccagctactcaggaggctgaagtgagaggactgcttgagcccaggaggtcaaggctgcagtgagccatgatcataccactgcactccagcttgggctatacagtgagaccttgtttaaaaaaaagtgttagaagggtctgataatttgcctgggtagcttgtcttcttacggaatttagcaagagtgttgtttttcttatagccgtaggaatttaggaagttgccaccctagcctctctgtgaactcagcctgtagcaaacttttctttccttaaccttagggtctgttttagttgctaaaggggcatttattttggtctctctgatgacagggccttgtgcaacagtggaggtccttcatcttgaagttcaccctgaacatgggtaatatcacccagacaacacctggagccttcacggtaacttagggcaagtgtcactggttttccaaaacccagccgaaatttcaggtctcactagacaggcacggccctcttcttagactgttcatgtttaaggcaagagctatatttaagctgagcaccaaaagatgcgtcgaattcagtttagcctaaagctgccccctgacatattttaaggtttgcctaaaggtttctccgtacgcagtgcactgaaacctaactggatgtgtaaacaggctggaacctacttttgtgccaatcacaaagttttgtccgaaggaagtcaactgtccaaaccatgctcaaatgaggccaatggtgagctggaacgaatttggctatttctgtacctcacttctgttttctgcaccccactttcctttttctgtccacagatcttctctcaacatgagacagtgctggggtctctctgaaccgactctggttccatgggctatccaatttgtgaatcgttctctgctcagttaaactctggtaaatttattttacttatatattgttatttttctttttttttcagagacaggttctcactctgtcacccaaactggggtgcagtggcagcatcatagctcactgcagcctcccacctcagcctcccaaatagctaagagtacagatgtcccccacctgcctcagccacccgagtagctgggaccataggtgtaagcctgttttttctttttttttttttggctttagctgctagaggaatcctggtgccactggcagatctgatggaagaacctatgcattgcaaaccctgggttggagatgccactgagatacctcaggggaaatgccgaggaaggagtggaaggctggatgacaggagactgttggtctgcatgtgagacagaggtactaggggatcctggtttcagccacactgggtggttttctttaaatttacatctcatactagttcaagtcatatctggccttctggggacacagtcccaacatgtttcttttgttgttgttttttgttttactcctctgatgctacaaaggctcgaatgtatacttcttttaaggtgccctggctcatgcctgtgggccgaggtactcaggaggctgaggcaggaagatggcttgagcccgggagttcgaggctgcagtgaactatgaatgcacgactgtactccagcctgggtgacagagtgagaccctatctcaaaaaaaaaaagaaaaaaataaacaagatagtgcatttcaatgaaagaacattctcttaaaacggaatagaaaacactttcgatggatgggcagggtggctcatgcctataatcctagcactttgggaggccgaggcaggaggattgcttgagcccaagagttagaaactagcctgggcaacatggcaaaacgctgtctcgaactcctggcttcaagtgttctgcccacctcagcctcccaaagtgttgggattacctgtgtgaggtactgcgcccgtccagataccttgtctctacaaaaaacacaaaaatcagctgggcatggtggtagtgcatgctgtcccagctactcaagaggctgaggtgggagaatagcttgagcctgggagatggagattgcagtcagtcgagattgtgccacagcactccaagctgggtaacagactgagaccctgtctgaaaaaaaaaccaaacaaacaaactaataaacaaaaaaacccaaaacgggccgagtgcggtggctcacacctgtaatcccagcactttgggaggccgaggcaggcggatcacaaggtcaggagtttgagaccagcctggccaacatggtgaaaccccatctctactaaaaatacaaaaaattagccaggactggtggcgcatgcctgtaataccagctacttgggaggctgaggcaggagaatcgcttgaacctggaatgtggaggttgcagtgagctgagatcgcaccattgcactccagcctgggtgacagagaaaaactctgtcttgagaaaacaaacaaacaaaacaacaacaacaagccaacaaacaaaacaaacaaaaacagagtaagccaggcttggtggctcagcctgtaatcccagcatgttgggaggcaaaggtgggagaatcacttgagcccaggaatttgagatctgcctggacaccatagtgagactccatttctatttatattaaaaaataaaaattaaaaaaacagagtacctcagagtcacatgtcatcagtgtagatacaattattacccacaaggggaagaagtgtgtccccagcaaagtgagaattgatgatatctcttcagatgtttaatctcatgaatcaacatcagttttgttgattcaatggtacaaatataaagttccatgaaggaaaacagtcctaatgttagataggtcaggagggtgactatagtttacagtaatctattacatgttcaaaattgctggaagaaaagaattcaaatggttctagtacaaggaaaagacaaatgtctacggtgatgaagatcccaagtactcatttgatttttacaaattatgtgaatctattcaattattacatgtatccccaaactatgtagatccattatgcatcgattaaaaaaaaaaaagaaaactccaaaaaacccatgagctttgaagtagatttcaatatgtttcatattgaatatttacatattgaatattcacatatcggcatatttacatattgaatatttacatattggcaaatttacatattacatattcaaaaagcatgtaatgagtggagaataccccgagggaacatgctagcagtgtggttaccatatttgtctttctcttatgttttagtggagagagaaataacagtactagttcctacttcattagtaccaggaggagtgtttggcagtagaaataaaggaacgttagaggaaattccccaagtttggaaaggaaggaaggatttcccgagaaagtgatgtttgaaggaaaatctgatgggtgagtagggtaaggggtggtaatatggagcattgggtccttcctggtagagtttagcaaggaatggagtagggaaactgtaaccatgagatcaggttgaaccagttcaactcaattgtttaagctgttatacagttgaaacagaaccaacattgcatgttgtgtagcctgggcacaggcaaagggaaaaagctttgacctccaatcacactggaaactgatgatgcttccctatggaaccaaagacagctggacatgaccagaaccaggatgcagaaacccattcagaagcaaaaggtctactctcccagaagacattgtgctgaaatccaccattccataccttattataatagccaaggttaaagccctttgattaaaacttgccgcaccagcacttccacatacttctttttcttttcttttcttttctttctttttttttttttttttacacggtcttgctctttcgcccaggctggagtacagtggcgtgatcatggtgcactgcagccttgacctcctgggcttaattgatcctcccacatccacctcctgggtgggtagctgggaccacaggcatgcaccatcacacctggctagtttttgtattttttgtagaaatatggtttcgctatgttgcccagactggtcttgaactcctgtcctccagcaatcctcctgcctcggcctcccaaagtgccatcattataggcatgagccactgtgcccagccacatacttcttaacccataaacatttgagctaactccccagatcagggagacagatttgagccctgcctcctgtctccttgccagttgacctcacaataaagtcttaaaaagaaagaaaaaagaaaaaaaaaccggtaccctacagcacggcgtggtggctcacacttgtaatccaagcactttggaggctgaggcaggtggattgcttccgctcaggagttggagaccagcgtgggaaacagcaaaacccagtctctacccaaaaatacaaaaattaactaggcatggtgatgtgtgcctgtggtcgcagctactcggggggctgagatgggaggattacttgagcctgggaggcagaagctgcgctgagtcaagatcgtgccactgcactccatcccgggcaacagagtgagaccctgtcttaaacaataacaacaaaatccccaaagcaatgccctagtattggcttatatacatgtcaagcagcaagcccattgctcagtaacaaaatgggtgacgcaaccctgaagagcagtaagaactgcagtgtggctgggagacacagaatgaggtaaacgatggcaaacattgaggacggagaggtagcaggaaagaagcaacaagtacagatgattcagacctcgtggtccgagatgaggagcttcttctttatcccaggaacagtggaaaaccatgaaatgggtctacacagaacacagcgtggtcaggtctataatctcatcttctactgtgtccagagggttttggactagagaagaataaggctgggaattgaggcggtacaagttagtggggtgttgcaatcaagaaaggaagagatgatgaaatcttccacctggctcctaacattatgagagctggcacgatgtagactggtccaggagctatttagggtcaagccacaagacaggaagattaaatgattcatgattaaatgatattcgcagcctccaataaatcaacttcactattattcatccttgttttcttgttccagaccaccatctctgagaaagaagtaggattattgtcagaagtcttctttgatcttttgttctttccttttttaggggttggggagaaagtctcactgtcacccaggctggagtgtagtgacgtgatgttggctcactgcaacttccacctcccagtttcaagcaattctcctgtctcggcctcctgagtagctggtattacaggtgtgcaccaccacgcccaggtaatttttgtatttttcatagagatggagttttgccatgtaggccaggctggtctcaaacttctggcttcaagtgatccacccacctccgcctcccacaaagctgagattacaggtgtgggccatcactcctggttgctctatccttgaagggctataatggaaccaaccaaggaaagaacatagcagcaaatggccactcctcaccttggtatttctgggaattttatgaggctactgtagaaaaatggtttgatgaaatgaagcctgtgatcacctagtaaattgtagagaaatggcttccacatgtgaggttgtcctttcccgaatacatgaccttaaggtgaaatggataaaacttctggcttggaaaggtagttagtataattaggaccatatttatttttcaaatacagagttgaggacccctgtcgttttctgtaatgcaagtctaagtgggctcggagggactgtgaactctggtcctggaactgatttcataacctggggcacgttcatggaaatatacggttggaagggagcttggacaggtctctacagatcccactgctgattggttttgatagaagaaatcacttacgtgcctctgtagttgactccattttaataagacagcgcagcttcctctcttctcagctttgaacatctgtggagacagagaataaggattctcatgccatcttttaatgatgcttttataaaacttttgactagatcgcagggcttgcctctacttttctcaagatgcattaagcattctttcttcccatttgcattcaccaacccccttagcttctctgtgtcctctccaaccaaatatttttttaaaaataggcatctacacttgaccaaaagttgaatacatgtctacctgaggatactaaaagagttctatcttgattttcatacctctgacctatatgttattttgtcttgttaataatcgtaacttccaggccaggcacagtggctcatgcctgtaatcccagcactttgggaggccaaggcaggaggatcacttgaggtaaggagttcaagaccagcctggccaacatggggaaaccctgtctctactaaaaattcaaaaattagccaggcgtggtggcacacgcctgtaattccagctacttgggaggctgaggcacgagaatggcttgaaactgggaggcggaggttgcagtgagccgagattgtaccattgtactccagcttgggtgacagagtgagagtctgtctcaaaacacacaaaaaaaaccaaacaaaacaaaaaactacattgtaaagatattccatgaatggggtcatactattagtaaatgtttggatcaacatctgtagtccttttaggaagtaataagaaggtataagaggagaggaaagagatctttcattgcaatctatgtgaggctttgggtgtgagctaggtttctggggttttctcagagagaaacagcaagagagagagaggcatgcttatattccatgctgccgagagtggcaaagatatgacagcattgcttcagcagtagtggtgacattgagagggagatggtcgtaggaagtgaagaaggagaattttcccagtggagcactttttttttttttttaatagagaaggggtcttgctatgctgtccagtctggtcttgaacttccggcctcaagtgatcctcccacattggcctctcaaagtggtgggattacaggtatgagtcaccatgcctgacccacagtggagcaccttggtgcttggctataaaagttatattcccaagaagcccaaagatggagaaaaaaatgtttgttgtgtttaccaaaaacaaggtgtctgctttgtatataaccccaagagagatcacctggcggcccctcccaaatatttggagaagaatttgcagaaagttccaagtccttcaagagtaaagacacaagagtaaaagaacacaccaacattcatgatttcaaagtttgatttgctcccgaatcgaaagccagttttttcattttgattcagatctatacgttcacaaaagccatgctcattttgcaaaactcttatgctaaaaagagcgatgcttcctccttctaaacagaaacccctgtctctacaagtgtctacttttcctactttctgataaagggaagacaatctaccctgtctgtttaattttttacatgcagcctctctgacacgtggaattgggagactggagtgccaaatccgtttttttcagtgtgtaattttatagctttccccagagcaaaagaggacaagtcaggcaagctgtaaagcagaggggaggaatttcatgggacaattttattatgccatgaaatcaagacagagtttgatgccaatgaccatcttggacaggcaggatgcagagagagatgaagcccgtgacctgcagaagcgcacttcgaagaaggcatgctgcaccccagccgttctctttgccctgaatggttcctgccttatgggaccaaggaaacgggtattgctaaaaaggcaaaattggcagcttccaggaaaacttctggaggaatgtactgaggcccctaacaaattaacatacgttgggtggctaaaaataacaagactttattctcccccagttcagaacacccgagcctgagatcaaagcatctcagggccacgattctccagaggctctaggggaggctccgtcctgcctctcccggctcctgggggctccaggcatccctgggcttgtggccgcaccactccagtctctgcctccgtctccacatggcctgctcctctgtgtctgtgtctgtgttacctcttctgtctcttattttattgcatttatttatgtattttctgcatcaaatcatccattgctcttctgtctcttatagggacacctctcatttgatttagaaatcactgtgatccagtatgatttcatgtcaagatccttaactaattacatctgcaaagaccctatttccaaataaggtctcattccagattctaggctttaggatatggacagatctttctgggggccactgtttagtccactacatttgtattcacttccttccggaggctctaggggaggatgcttcctgcctcttccagcttctgggggctcctggcatccctgggtttgtggccacatcactccagtctctgttcccatctccgcatggcccttctcctctgtgtctgtctctgagaatggcaaaggtctgacagcattgcttctacagtaggggtgacattgagagggagatggtggtagcaaatgaaagaggagaattttcccagtggagcactgtttaaaacaatagagatggggtcttgctatgttgtccagtctggtcttgaacttctggcctcaagtgatcctcccacattggcatctcaaagtggtgggattacagttatgagccaccatgcctgacccccagtggagcactttgatgcttggctataaaagttatactcccaagaaaaagcccaaagatggagaaaaaaaagtgtgttgtgttcacgaagaacaaggggtctgctttgcatatgacccgaagaggacacctcttagaaagacactggtcattggatttagggcccatccagataatccaagatgatcccatcttgagatccttaacttgattccatctgcaaagaccctatttccagataaggtcctattcccaggttctgaggttaagatgtgaactcatattttaaatgtctccattcaacctactacagcttccatgggacatatttgcccagcatccagtgatgtaaactggatttctgtgtgttttaagagctgtaaaggaaggaataattatcattcctgaaatacccttggtattttagcaaaataaaagttccccagatttgcttaatgaatctttacaataagtagcagggaattaagtatcatgggtgtgatttgagacttggatgaattaagggaaaaacttaaaagttgttaaaaccttactacctcctgccagctcaccagacacctttaatgcttcaggagcagcacacgaaatataatttttgaaggaggagagttccatgtccacatctacgccaatggaaaaaatagctgggtggaaaagactaggaaaatgaacagagagtaattttcaagatttcctttcattaaaaaacaaaacttgctggttcagagataaaagaaagtgaagcacttttttttgtaaaggaaagaattataagatttgaagtgaaacattaatatgagcagtaaatgaatagctgaaaatataaggtaaccttagtggaaagggattttgaaattattctttgaaactccctctttcatatgccttgttaatccgatttatttacgtgcatttaacgtgagcacagggactcatgcttttacttatgttatgcaggatttggtgtacaaagaaatatgtctacctatactgattttggtaatttgtaaaattaaatgaagattattggttatcatgtcttcctggatttgcaaatacttggtatacacccagtttcaattgtggggaagtatattatggggaaactcatgaatcactgcttattttttcaaagcacgtggaaattccactcacatgaaaaaacatacttccacttaaaatagcataagtccaatgggtgcttttgaaacaaatgaatcaaatcagaatcaaaattctctagctctctgatcttcagttgtagagttaaaatattaagggaaattgcttaaatgttgaaaaaattttgaacagatggctaccacataaccatatggaatcaatgacactccccaaatgcatgagaaagccattttaaaaattgatgatgcaactatagttggaatacacacacgtaaacacacacaaaatgacctatggcaagttttatttataccatgcaaatgttaagttaatcatcgcctctagttaatgcatatcccagattttctgacactgtggatgaaatctagacccacttgttgtttttgcagagttacatggaaatgttgattaaatccaaatggaatcacagtttagctgaattaaatgccaaatggctccgatcacttcctggagtgagagagaggggaaatcattgcaaatgcaacctacacaatgccttctgttgaaaatttagtggatacttggtttcacatggtcacctccaagcagtagcttagaaaagtggtgaaactttacagacagacagacagggagagagagagagagagagagaggataaattagacagatagatagatgagatagatagagatgacaaataggtgagatacctaattagatagacaaatagagatagatagacaggtgatagatatagatagaggaataagtgacagactagatagataagatagataattagacaaagatagacaggtgacagatgagatggataattaatagatgagataaatataatagatgagatagatagatagatagatagatagatagataaaataggtaggtacctaggtagaaagaaaaaggaaagaaagaaagaagaaagaaagaaagaaaagaaagaaagaaagagagaaagaaagaaaagaaagaaagagagagaaaggaaagaaagaatacatggatggatagataggtggtagctaggtatgtagataaatagatgatagataaacagacagaatatatgggtgaatatttagatagatggatggaatacatagatgaaattgatggatggatggatggatggatggataggtaggtagctaagtagttaggtggctagctggatagtgatatagtttggctgtgtccccacccaaatctcatcttgaattgtaactcccacaattgccatgtgttgtgggatgaacctagtgggaggtgactgaattacgggggcaggtctttcctgccctgttctcatgatagtgaatgagtctcaccagatctgatggttttaaaaaggggagttttcctgcacaagctccttctctttgcctgctgccatccacgtaagacgtgatttgctcctcctccccttccaccgtgattgtgaggcttcctcaggcacgtggaactgtaagtccaatactctccttttcccgtataaattacccagtcttgggtatgtctttatcagcagcctgaaaacagactaatacagatagacgcatagatagatagaaacattaattcatacatacatacatagatgatagatgatagataaatagatacatagatatatagatagaaataaatagaaagaataaacggtctggacagcaggataaagaacagaatttattgaacctaaattctccatatgcgtctgaaacagtgctagccaaagcccttctcagatacaagagagggccccttgattttcattcccttgttcctcacactgatacctccttgttctcagcagcgaggtgctctgtttagcactaggagtcactgtcccagctcctaatgcaagagacatctgcaggttagcactcaaccttaaagaaagaacgtgaaagctgtcaacgctgtggaatgggatgaagcgggagagcaggtgacagccaccattacaagtccgctggctccatcagtgctctgtgtgacttcagtcctactcaaggcagccctcacctgtgggctctgcacagttctttttggcttacaagagcatgcagggatggcgagagaggattaaggcttctgcttgcctctgtccaaccttgacccaaccttgagaaaagaacagtttaatgatgtcagagacagcacaaagaacaggacttgcaagccagttagacctgcattttaatcttagctttaaagctcagtcaagatatgatcttcccaccttcctgcacctctgagatatcctgttacacgatgggcgttgttcttcgcaacatcatttgcatgtcaataagactgcagtgcacacattcaaatacaggaaggctttgtttcacacagacatcactttgagtgagccaggattgagcctctgacacagctcaatttacacaaatagcaatttactccaaaaattaactgattttttaaataaggtgttgacttactttacagttttgtttttcagatgaaaatattgagaggttttttttttctcttgtattctttacacttagagttggtttatcacacggtagacatcaagaatttgttgagtgagtcaacaaagaatctaaaattaatgatgttaatacctggtgttgtttgccatatgatataagacacggatttttttttttttttttgaggcagggtctggatctgttgcccaggctggagggcagtggtgtgatcttggatcactgcaacctccacctcccaggctcaagtgatcctcccacctcagtctcccgagtagctgggactccaggcacatgccatcaccacaacccactaatgttttttgtagtttttttgggtagagatgggtttttgccatgttgccaaggctggtcttgaacttctgggttcaagcaatctgtctgcctgagcctcctaaagtgctaagattacaggcgtgagccaccatacctcgccaagagtttttaatatacatcaaagtttccatagatcatatagttgttgtttattattattattggtagtagtagtagtagtaatttatttttcaaggtgagatcttgctttgttgcccagaatggagtgtagtgttgtgatcatgggtcactgaaatcttgacctcctggggtcaagcaatccatccacctcagtctcctgagtagctgggaatacaggtgcacgtcaccatgcccaacaaatttttctattttatgtagagatagggtctcatcatcttgccaaggctggtcttgaactatgagcctcaagcaatccttccgccttattattattattattattttgtgaaggagtcttactctgtcacccaggctggagtgcaatggcatgatctcggttcactgcaacctccgcctcctgggttcaggtgattcttgtgcctcagcttcccaagtagctgggactacaggcatgcatcaccacgcctgactaattttttttatttttagtagagacagggtttcgccatgttggccaggctggtcttgaacttctgacctcaggtgatctgcccacctcggcctcctaaagtgctgggattacaggcatgagccaccacattattatttttaatagacctttatttttagagcagttttaggtttacagcaaaatcgagtggaaagtacagagactatccacatactctgtgcccccagacacgcacagcctcctccactgtcaacatcccccactagagtggcgcatttgctgcaatccatgggcctacattgacacatcatcatgacccaaagtccatagtttaagttcctggttggtgttgcgcattctgagggttttgacaaatccataatgacatgcatcccacactatactatcacacagcatagtttcacttttcctaaaatcctctgtgctccacctatttatatccctcctcccccaacctgtatcaacaaccgatctttttattgtctccgtagttttgttttttccagaatgtcatataattgaaagcatgcagcagagagttaactttaaaaaataacattctgaattatttcttttggaaagaaaacattattttttagtcaagatgaagtttaaataactactctgtgtcagacattgtatataccttacctaatttagttgttaacatctttgtgaataaagtgttcgcatcctcattttacactacagctcagagaacccaaattcaggcagggtatgcatgtgagcttctttgcttttgagccctttgctgttgactctacatttgtttttggaaactccaggtctgccattggccatcagaataccttgatcttgactttgaccttaggcttcatttatttctatccaggtaccattaaacaggttgaagccaccacgaagttgagatttcctacacacaaaatgttcttatgagcaggctgggcacggtggctcacgcctgtaatcccagcactttgggaggccgaggtgggcagataacttgaggtcaggagttcaagaccagcctagccaacatagcaaaaccctgtctctactaaaagtacaaaaattagctgggcgtggtggcatgcacctgtaatcccagctactcgagaggctgaagcaagagatttgcttgaaccctggaggcggaagttgcagtgagccgagattgcaccactgcactccagcctgggtgacagaatgagcccctgtctcaataaataaataaataaataaacaaaccaataaacaaataaataaaagttcttatgagtgatcatctctttgaggaataagggaaaggccattcttataaacaattcatgttttattatcactggtcttctgttttattgcatatttgatgggcaagtgaagaagaagaccaaaagaattttggagaaatgcctcgtgtagatagagttagtagttagagaaatcaaatgagagagaggaccttatttagaaatgaaagtctacctgggttacctagatatattagagaagttttggtttttcacttggtagaatactggtaaataattctttcctttccctttaacatcttaatgtgaattttattgcaattttcttattgggaaaatcaaagtaaaaccataagaggttgtgggtctcgtgaaactctacttaacataaagcagaaagtattgagatacacggagaagctctgaggggctcagtgggtctctctttccctggactgtgttacatgcatgaattcacactggaattccagatacagcatcctttttgttgaaatgcttttcaggcaggctctgtagggacctttctcagaatcaatgactggtgacacctcttcgtagcctgcacttatatttggaatccatataacctccttgcatgcaaatacacaaagatggaaatgccacatctagccgtaattaaagagagtgaaaggtggataattgctgctgtaatcaattgtgtttctatgaaaatgcttaggcataattttaccaaattaatattacagtaactatgtacttgagtcaacttctactcagttcatttgggtttaaaagaaacacagagatgagccagtttttaccgagaaaggcacacacagtaatatttttagttcttacagctggtcatgaagaaaagaggttctggattctatgatccaccttgaaaaaaaagaaattctagtttctatggggaaaatttaactgctatggagaaattctaatttcttgggggagaatgaggtgccaaagacaggaagggaggaggagttcagacagaagacattcatgcaggaagtacaacacacacacacacacacacacacatgcacacgcacatacattcacacaaacacaagaggagtagggtggacacttcaataaaagcaaggactagaatgaaaaaatgcagacctggcacggtggctcttgcctgtaatcccagcactttgggaggccaaggcgagaagattgcttgagcccaggagtttgagaccagcccgggcaacatggtgaaacaccgtctctacaaaaaatgcaaaaaaattagctgggcatggtgacacatacctgtggtcctggatagtcgtgaggctgaggtgggaggatcttctgagcttgggaagttgatgctgcagtgagccaagattgcaccactgcactccagcctggctgacagagggagactctcaacaaaacaaaaaacaaaacgaaaaaatgcagaagaaaaatatttgtataggatagcaaaaaggagcatccacttaattgaaatagccatagtatgccaaaaagtttacaggtggtgaagacagattaaaataaagcagagaaagttgttagcttgggggtggtcctcataatatgcagacaatcaaggtaagttgctgtgtgatgataatggaaatgtggatgtgaaggtcaacaaaaaacaacgacatcacctgttttgcaattgcccacttctggtgtctaatggtcaccaaatgcttccataggcaataggagatgaagggtgggtgggaaaaataaaatggcaataagaaactatccaaagacatgagggtaacctccaggcattgctgagagtgagggtagaaaacaacagtgctaaaatgcacacatgattaccattttggattctcaacaaagactggggttttcatttgtaaagactgttaactaatgtgctcttgaattccgtcatccctgctgcccagatctcctgcactgccaaaaatttagccagaaaatccgtgcgagtcatcctgctagtctccatagactagaaataaaagttaacttgttccaaaacttttctaattagattgattgaattgtactgtgcctcaaagtcatttcttttccagctcattaagctcatcctataaaaacatatgacattgttcatattcattgcaagtggattaattatccagtatgaattgtaggttccaaatgcattgaatcatatcatcatggtgggtgtagttttttaaaatcacttccaaaagagagacatttatttttgtcggtttctttgagcctctcctcatctaaatgctgtaaagacagaaaaaaatcccgacacaatttttataactagtgtaagtatgttgataaatcccacgataattccctccactgttattagttaagaattaaactttgttatgcaaatgaatcaatattgagacatacatgtcaaatagggaacaaaatgtcttaaaacttattttttctgcagagttttctttttccaaagtgtacaaaagtctatcattcttggatgttttcttaagtttattaataactttgaacaccacctttatcgatttttagaattgttaaccaggatttcttgacaaacaggttatgctgatttgaatcaggccatcaattgaaaaaaatgcctaaagttttaatatttaagtgtgctgaaataaactggtgtcaccctaagtaacagagaaagcctctgtaaaagaaaagatatttatttgggaatgtagcattgcagtggaaattcgcatgccataggaaactatgtgcatatttggtgggggaaggaagacaaagattttttgtaagagaagtattacttaattgttttgaaataattatctgtggctacaaagatcgataacaaagatgggacaggcacggtggctcacacctatagtcccagcactttgggaagccaaggcaggaggattacgtgagcccaggagttcaagatcagccagggcaatatagtgagaccctgtctctacaaaaaaaaaaaaaagaaaagaaaagaaaggaaagaaacaaagacaggaaagaaagaaacaagcaaaaaataacaaagaaaggagagacaaaaaagaaagaaagagaagaaagaagaagaaaggagaagaagaagaaggaggaggaggaggaagaagaaggaggaggaggtgggggaggaagaggaaggagggaaaaagacaaagaaaggagagaaagaaaaagaaagaaagaaaagaaaaagaaagaaaggaaaaaaatagaaggaaagaggacagacagagaaaaaaaagaaagaaaaagaaagacaagggtgaaaaaggaagtgtgtctttctcaggagagtaacaggaagtgtgtcctgcacaggacaagaatagaaattgtgtgctgcacagggtaggaacagtaagtgtgtcctgcgaagaagagacacaggaagcgtgtctcacaaagaggaggaacaggaagtgtgttctgtacagggagaaacaagaagtgtatcctgcacaagagaggaacagaaagtgtgtgctgcacaggggagaaataggaagtgtgtcctgcacaagggcgacacaggaaatgtgtccagtgcaggggagacacaggaagtgtttcctgaaaaggggaggtataggaagtgtgtcctgaacaaaggatgaacagaaggtgtgtcctgtacaggagaggaacagaaagtgtgtgcttcactgataggagtaagaagtgtgtcctgcaaaaacgaagtgcaggaggtgtgtcctgcacagggaaagaacaggaaatttgtcatgcacaggagagacacaaaaagtgcatcctacacaggggagaaacaggaagagtgagtctcatgagagtaacaggaagtgtgtcctgcacaggggagataaggaagtgtgtccttcacacgggagacacaggaagtgtgtcctgcacagaggaggaacaggaagtgtatccttcacaggggagatacaggaagtgtgtcctgcacagagtgggaccaagaagtgtgtctcaggagagtaacaggaagtgagtccttcacaggaaagacacaggaagtgtgtcttgcacaggggaggtacaggaagtgtgtctgtctcaggagagtaacaagaagtctgtcctgcagagggaaggaacagaaagtgtgtctgccttaggagagtaacaagaagtctgtcctgcagagggaaggaacagaaagtgtatgttccacaggggaggaacaggaagtgtgtcctgcaaggggagacacggaacgtgtgtcctgcacagggcaggaacgggaagtgtgtcttgcacagaggataaacaggatgtttctcctgcacatgggagtcacaagaagtgtgtcctgcacagaaaagaaacaggaagtgtatgccatacaggggagaaagaggaaatttgttttttacagaagagaaatagaaagtgtattctgcacaggggaggaacagaaaatgtgtccttcacagggggacacaggaagtgtgtcctgcacaggggaggaacagaaagtttgtcccttacaggagagaaaaaggtagtggcccatgttggtctcgaactcctgactcaagggatcctccagccttggcctcccaaaatgcaggaattacaggcataagccactgttcctgaccctcagatcatttctttatggccagtttttacttggaaaggcaggtggagggaattagagttatatttttaggttttatgcttggctttggggaaaagggggtcttgtttctaggactcgccttggggaggagggtttctaatttctaccgtgccttgggtcagagtgggactgagatactcaagatggcgagtaaagtgatgtctgatcgtcctcactgctacactcctaccagcgccatgacagtttacaaatgccatggcaacgtcaggtagttaccccatacagtggaaaaagaggagacaggaataatccaccccttgtttagcatatcatcaagaaataaccataaaaatgggcaaccagcagccctcagggctattcttgtctatggagtagccgttcttttgttcctttactttcgtaataaacttgctttcactttactctatagactcgccccgaattctttcttgcgccagatccaagaaccctctcttggggtctgtttcctggacccctttcctgtaacaatatttgttcaaaataaatctcttcaaatattttacagactttgactcttttcattgacattcctgtgagtcaggggtgagaaaaataatgacgtttttgggaagagagaaaaaacctgtacctgatggaacacaaggatttgttttctctctcatcctgggcccgttggctttttaagtatagctaccccaggtatttgtgcgtgctctctctctctctccttttctttctctctctctcatacacattccccccttttccttccccccttcctttttccctctcttttctctacctgtcttcctcccttgtctctccttactttctttcttctctctctctgcttctcttttctccctggtctctctctctctctctctctctccctctcttcttcctatcctctctcttctctctctgtctctaactttgtttctcatattctcttctctctctctccactttttctctcctttctgacttccttactctttctttcccctctgtccttctccttttcttccccatctcctcctcttcctcctttcttctccttctttcttcttctctttctcctccttttcttttcctctcttgtcttcctctctctttctctttctcttcttttccctctctcttctctctgtctctcatttttcttattctctctctgtctctctctgtcttcctctctcccgctcacctctccttttccattaaagtctgcaaagagttcccatttcttctagcaattgagatttctagacatcaccagggtggctcatatataccctaggatgtgattacctatttgggctgttgaaggagtgaaggatgtgccttcccaaaatatgctggattggtatcttgcatattttgagttgaaaacactagagaaattgtagtttcagaaagtgctagccgacctgtttcttcctgtaggcagcaagccataaagattcctttgggaggggactcctccccgtaccagggtgagaaaatagctctcatcaccagagactgggctttggaacctgcagtggacctcaacaaatgcacttcccactagtttaacccctcctatatatctccttgtgactttcccagaaattcactgcccctagccagatcccctttgtttttcatttcttctcaaatttgtcattctttgtttaaaaagcataaaagcatcttggtttggtcacctctttgaacatcacgcttaggaagatccccatggtccgtggaaaatgaacaaaatctgtatgttttcctttgttaatctgcctagcatcgacttggtttctagttgcagctacagagctcactaagagctaaaggaggttgaaggggacctctggctccccctcccccatgccatgcacacaagggagctgacccactgaccccctggacgactcatggacagctcagtgggacgggagctttggaggtcataggagtgtttatgcagaccccagagtggcttcctaggaggaacaggattcagcagatcaaagtttcccagcatctgtgatagtctgaggccagcaggagggaaggaaaacaaagactctcaaccccagccccaggtgtcatgaacattcatgggggagaaagggagcagagagtgttgagtctctgaagaggggacagtggaaaacagctctaagcagaaattgccggcttcacttcacttctgtgccttttccctctgctgtctcctgaattacatttgtttttccacaaaagaaaaagaaagaaagaaagaaagaaagagaaggattcttctgcctttggtaaccatgcatgagaatgttcacatttcttcttctcttctcctccctctccttttcctctctcctcctcctcctcctccctcttccttcttcttctttttcttcctcttcttcttcttcttcttcttcttcttcttcttcttcttcttcttcttcttcttcttcttcttctcctcctcctcctcctcctcctctccctcctcctcttcctcatccttcttcttcttaagacagggtctcactctgtcacccaggctggacaatcatagctcactgcagcttcaacctcctgggctcaagcaatcctcccacctcaacctcccaagtagctgggactacaggtatatgccactacgcccagctaatttttgtattttttttgtatagataagaccttgctatgttgtccaggctgttcttgaactcctggccttaagtgatcctcctgcctcagcctcccgaagtgctgggattacaggcatgagccaccacacctggcaaggatgtctagagttctaagagcctgtggacaagctctaagaagaaatctcttttgttctctggcacaaattgccacaggtcccttttcccacgacttatgtttctgtccttagcactaatggtttccaccttgtgaggggtgaggctgttttctcccaaccatatgggaatatgcatgttaggacttttcgtggtataagctctaatgggatttccaagtaagaaaaaatttgctagtctcaggattttagttttgttgttacaccttttcacgtttctgtggggtggtgaggtaggaggaatgtctctttttcccttttaatttttgaaactgccttttcttctttttaaggatgagtgttcacaaattgtaaaaacttccatgaagcatgaacaaggtgagtcacagcctcgtgagtctctatagttgccagcgttgactgaagtgattgtagggagagtaagagcacctgtcttcatcccttactgctccattctgaaagctccattttattttccaaaaatgtaccccataattcactgctcccttctccattggagccttgcagtatcaaaacataatttaatatttttgccactgtggtataaaaaaagaacagacaagtctgtgagtttgcaaggacactggactttttactctttccaatgcaacttgggagactgtcatctggattaggatgtgggcaaaatttggttttcatctctcgcaggggttacagaccttgggatcctggtaaacacacatagactctcacacacacacagtcacacacacacaaacatacacacacacacacacagtcacacacataccacaaacaatgtttttttctgcaagagacacttttctgttttattattctttttattgcttgttttttattttacttctattttcccaccagaaatagtggcttcaaagccataaggttaacacttgaaaaaacaaaaacaaagcatagagaacggtgcaaatttgattcatttttttttctttcaatcttccaaagtggatgtagaagggtataaaataaaagttgaggaactaaagttttcatcaaaacctgtggtgttagggtgtaggtttttattttattattttattttcctgaaaagagttaaaggaaatagtttttttctgggaagggtgaagtttctgtgagtgttttgtgggtttagagattgaataaatcaggaagacaacagatgtttggtgtgattagcaggtctgattgaatggaaccagctttgaagtctaattgaagacatttgacattaaaacgccaagattatttaggtgcttcacaaaataaaattaaaaatgagacccagtaaaggaaaaatacataatatgaaacatttgttggccaggtgagagactatgctgatgaaattattattggcatccgaagactccactttgattgaaatttatttaaattttccattctactcagtggtgttctgctgaaaacagtaaaaatttgtggaatatgaaaaataagcttaagtacctttttcaaaatcagtagatgtgactagaagaatttaaaacaagatacacaattaacaactatttggagaagaaagatgaagagggaggtgaatgggaaatgaatttcttatatttcagatttggaagtcaaaacatcctgcttaaaagagattggcatataaatacagctatcttgcataaaatttcagagactatcattcaagaatttaaaactgcctgggtacggtggctcatgcctgtaatcccagcactttgggaggctgaggtgggcagatcacctgaggtcaggagttcgagaccagcctggccaacatggtgaaaccccgtctctattaaaaatacaaaaaaattagctgggcgtgttggtgggtgcctgtaatcccaactactcaggaggctgaggcaggagaatcacttgaacccgggagacggaggttgcggtgagccaaggttgcgccattgcactccagcctgggtaacaagagtgaaactccatctcaaaaacaaaacaaaacaaaattaaaaactgaaaaggcaaaagggatttctatgacctcccatttgaccatatctagaaggggagagggaaatactttccacatatttttacctttgtgaactattgtgtttttatggctgtcttgcaggtatcaatgtttcaccttggaacagggaaccaaaatagtacataaagctctattatcacatgatccagcaacctcactactgggtgattgcccaaaggaaaagaaatcattatatcaaaaagatccctgcacacgtgtttatcacagcaccattcacaagagcaaagatatgaaatcaacctcagtgtccatcagtggatgattggataaatcgaatgtggtatatatacacaatggaacactacacagccatacaaaataaaatcatgtattttgcagcaacatggctagaacgggaggccattatcttaagtgaaataactcagaaacagaaagtcaaatactgcatgctttcactaataagtgggagataaataatgtgtccacatggacatccagcgtggaataatagacattggagactcagaagggcaggaggctgagggggtgagggatgagaaattatttaatgggtacaatgtacactattcaggtgatagatacattaaaagcccaaactttaccactatgcaatatatccatgtaactgcacttgtatcccttaaatttatacaaataaaaaaaataagcttctacatatactttgcaccaacccattgtattttacttcccatcagtagaaatacaattctctcttttacttgaggtaaaaaaaaaaaaaaaaaattcgttgttgttattgtttgttttgttttgtttctacgatgagaaataccagttcatggcattgctgaggggaggctacatgaacagtaagcagtcaaagctgcaacaaatagaataattaataagacttggtctacccaaagagacagcaggacccatgatggagaaggtgcgtgtgaatgaaatcaccccagcaaggcgtgtgcattggtttcctggagggctgccatcacaaattactacacactgcatggcttaaactaatggagatttattctctcagccttctggaggccagaagcatctgaaatcaagggatcagcaggatgggttccttctggatgctctaggaaacactctgtttatgacacttctgcttctggtggttgccagccattcttgacattctttgacttgtagatgcatcactccaatctccatctccatcttcacatggtctttttctttatatctctctgtgtcctctcctcttctgtttatttattttttcgagacccggttatgagactggctaatttttgtattctgtattttttgtacaaaagatgtttcaccatgttgcccagactggtttcaaactcctgggctcaagctatccagctgcctcagcctcccaaagtgcttggattacaggcatgagccaccacacccagtcctcctctcctcttcttataagggtgtcagtcattaaatttagggcctacttaacctgcaaagattctacttcccgataacgacacattgtgaagttccagatggccatgaattatgaattatcagtggagaatactacttagctcactacaacctgcaaaagtgcaagaacacaccttctgtaatcttctgtgaccagaggagggaaagagactcaaaaagattggaagggctgaggctgagaaatggagtgaatttcctatgggtgacttttccatttccaggaagtatgtggtaagattatgaaggggatcagaatatgccaccccaaaatatgacactttggtgcaagcattattttgagctaaaggctactgagtaaaagtagacacaggacaagctttctaccctcccactttctgcttaaaagcagggcatatgttttccatttgaaaagaaaattcatttgtaaagaaaaatttcatttataaaggtgttctctcatggatgattccagagatagagattatcacctgagatgacttgagtctatataataatctatacttaccaggcattttctagtcaccttctacaaacttacccctatcctagaagcttaaattccatttgcctttgtctagttctttatctaaactttgtcgccctgtgttaagatggtatataatcccctaggcccaagcacctctttggggttctcacttcttttccatgtgtctctccacgtgcacacaaaataaaccatttcttctgtaaacttgtcttttgtcagtttaatttgctgttctcagtaactaaatcaaaaaacgaaggttttatttttcccccttttacagttacctattaagagtgtgtttgtgtgttggggagatgggaggttggtgggattggcagtggaagggtctaatgttagaagacagcagagagttaaacattgattttgtcaatggcaaagagcaggatgacaaggcagtttggagacctggttggaattagggacctaactgtgctgtggcaccagcattgttagtggagaccagccccctggataggaaggggatctctggcatttgggctcactcctttgagtgagctaccatcattatggtagttttctaggtaaatgtttgcatagacaatggggcaaataattaaacattgtggagaattcctcaggtgttggaccatggaatttaagttgggtgggtagcaaaatggaggaagcagcactagtgaagaaggattaggcaaaagagtcaatgaattcgagagtctacctttgcaaatatggttgtgtttttctctctcctttcaaaggattatcaacatcctcatttagcggtattggtatgagcaacaatatttcctagcacaatctgtgaagtattcagtctgaggatgacttcagcaagtcaagaaaccttagaagaacaaacattttctttttttgagacagggtctcactgtgtcattcaggctggaatgcaatggtgtgatcctggctcactgaagcctcaacctcctgggctcaagcaatgctcctacctcagcgtcccgagtagctgggaccacaagcgtgtgtcaccatacctcgctaacgtttgaatttttgtagagacagggtttcactatgttggccaggctagtctcaaactcctgggctcaagcaatcctcccacctaggcctctcaaagtgctgggattacaagtatgagccaccatgcctcgccaaaatttgtctttaaaaccatctttaaccatatgacccgatcactccatttcctaggtatatattaaggagaactgaaaacaagtactgaagcaaaaacttggtatgcacatattgaatgcagttctgtgcccaagacacggaaggtggaaaccaccccaaattccatcagtggttccatgaataaacagaacgtgggccatccagacagcagagtaccattcaggggctgggggaggaaagaatggaaatgtctccttaatgggtacgggatttcttttgtggtgatggaaatgttctggaactaggtagaggtaatggttgcatatcattgtgaatgtgcgaaatgtcactgaattgttctccttaacatggttagtttttcttatgtgaatttcacgtctataagaaaaatgaaaaaataattcctctctgctctttcttgttatgagtatatacccaaaggaatagaaatcattctattataaagacacatgctctcttatgttcattgcagcactattcacaataacaaagacataaaatcaacctaaatgcccatcaatgacagattggataaagaaaatgtggtccatatacaccatggaatactgttcagtcattaaaaggaacgcgatgatgtcctttgcagggacatggatgtagctagagtccattagccttagcaaactaacacaggaacagaaaaccaaatactgcatgttctcacctataagtgggaggtaaatgatgagaacacattgacacatggaagggggaatacatactagggcctgtcagagggtgggggatgggaggagggagagcatcaggaagaatagctaatagatgctgggcctaatacctgggtgatgggatgatctgtgcagcaaaccagcatggcacacgtttactcatgtaacaaacctgcacatcctgcacaggaatccctgaacttaaaatgaaagttgggaattaaaacaatataaagaaatattccatattcttaaaaaaggaaaaataaaagaaaacattttgatacatattaaatggtccataggatcacaaatatgctatctattacatgatttccctactagtgtttctgcggaaaaacaacttctgaatgaaacaaccggaaaagcacaatcttcaggcaagacacgtttgacaggggctttttctgtcactttgttcagaaaatagttttgtccttgaatattatagggaggacagttgaaacataaaatgaatggttgttaaagtgcagcataataaaatctttcattttatacattgctgtctaaactcttgaatcaatactttacattggaaggttctaccttagagaattaatttattctaactgtactgtaaaataaaaagactggggacccaactaagaaaaacaaaattaaccagccaatttatactgtcctgaaagtgaaggcaaccaagtatttctgccttatccctggaggttttatccaaagggaatgtattagtccattctcacactgttataaagaaatatctgagactgggtaacttattaaaaaaagaggtttaattggctcatggtcctgcagggtgtacaggatgcatggcagcttttgcttctggggaggcctcagaaaacttacaatcatggcagaaggggaagctggtgtcttacatggctggagcaagagggagagagaggcagggagatgctacacacttttaaacaatcagatttcatgagcactctatcatgagaacagcactagaaggatggtgctaaaccattagaaaccgtccccatgattcaatcacctcccaccaggcctcacttcccaaattgggggttacgattcaacatgagatttgggtggggacacagattcaaaccatataattccacctctggcctctccaaatatcatggtcttctcatactgcaaaatacaatcacgtattctcaatagtccccccaaagtcttaattcatgccagcattaactcaaaagtccagtccattgtctcatatgaaagaaggcaagttccttctgcctatgggtttgtaaaatcaaaaacaagttagttacttccaagatacaatgggagtataggcattgggtaaatactcccatttcaagagggagaaatctgccaacagaaaggagctacaggtcccatgcaagtctgaaactcagcagggcagtcatcaaatcttaaagctccaaaataatctcttttgactccgtgtctcccatccagggcaccccagtgcaaggggtgggctcccaaggccttgggcaggggaggtctcagagaaaaaatcatgctgcagttaccctctgtgtgaatcaaagaaatttattttgcttttttttttttctaattttctcattatagaccttattttaaagctgtgagttgaacactggttcactgtgtgggaaaaaactgaagaaccctatcaatttacacactttatagggactgcttatggagccccttgctattctaaccacccggaaggtaggatctcagtggatgaaacacttggaaaaacaaatcattattctttcctattcatgcttatgttttgtttgaataatgattttgttttacttacaggttttttttttttaacttggctttacctacggagtcatttataatgtgtcagacatcctcgttcaatgggaagtctgctgtataggactcaatagtagttgctcaagaaggggaagttaatagtgtgtcagaagtcagtgagaagccagacatcttcctcccccatggagaggcacaattatatgcaattacatcttccttttcatgcctagggaagtcactgatatatccactcataaaataccagactttgggtgtctatttagaagtttttacagctcaaaaacaaattttaaagacagtctcaaactcaatgtcttaggaaggtcaaccttaaaatgaatagaagaccttaagttgtaaaatgtagggctcatttaatttatagccatggatctgtgtatttcagacacacatggggaggagggaaagtacaatgtcatgcagggctaagaatcacctagtccaagaatcccgcaaaacctctcaaccttgttttcccaatggccaatgttgctgtgaacatgaaaattgaggcagtttcaggcactcactatagtataaattgggttctcttgcaggcaacactgaggccagcattctgaatgtgcaactttggactaagcacattgcacatttaggaatgtaatctaagcaaatactttcagttgtggatgcaattatatttattgtaatgttgataacgttatagtaaagaaaaacaatgtgaatatatgtcagtgagagattggacaaatcaccttgaataaatatatgcaacagcatattatatagctgtgaaaatggacaaggtatttatttacattgtcaaatgaaaagatgatagagaattgagtagcaaagtagttccaaatagtatctgtaatataatgtcttttatgttaaaattacatgttaatagatgcactaaacattttcccagtgaaatggtatatgttgctataactgaagttacaagaatgtaaagacatggaaaggcttacatttgttcttaccctttcatgcagtctgtatttttatctatctatctatctatatctatctatatctatctatctatctatctatctatctatctatctatctatctatcatctatcatctatctatctatctgtatctatctatctatctatctatctatctatctatctatctatctatctatctatctatgtagagaccgagtcttgctatattgcccaagctggattcaaacacctgggctcaagcaatcctccagcctcagcttctggagtagctgtaattacagaggtgcaccactgcacgtagctattttttaaataataaacatttttaacacatttatctaaaacatagtgagaaaagaaaacagagaaacataatatttggaatactggggaatagcgtctgtcacttctgtcctgtctgttgctattttataaaaagccttaagaaccagcagtttacacgtagttttcaggcaatcagacatatatctgctatgagaccattttttaaatgatgaaataactgtgtgcgtgtttgtatgctttgtatatcagtttacagcagatagctattcaattcttctttgagatgtaaaaggaaaaaaaaacttccccaaggtgttgtgttacagactgaatgtctgtgtcttcacaaaatgcatgtgttgaaatcctcccttcaaagtgatggtgttatgaactggggcctttgggaggtgatgaggtcatgaggatggagcctaatgaatgggaagattgcccttataaaagagaccccagagggttccctcaccctttccaccatgggaggacacagtgagaaggcgccgtctatgaactaggaaatgagtccttaccagacatagaatctgccatgccttgatcatgcgtctccagcctccagagctgtgcatgatcagtgtgttatttataagccatccagtcttaggtattttgttatagcagactcaatggacaagaaaaaaaaactttggcttcaagcaaagtgagcttgctcctctgtccttaatagacacaaacaaatggacaaagatgactgcatcatcccaacccataaatcaaagattttcaacccagaagcaaagatccaactgacataagcaaagctcctgtctgtacagggataaacagaaagtgtgcagatcacaggtagcctctcctatttgtgcaaacccctttgtgaaactccacagattcatggcagaatcatcactttggtaaccaaaaggaaccttgcaatttgtacagtaattcatctataggtgcattctgacaaaccaagatattcttggcattgcgcttgtcattgtccatccagtgaagagcaggatggattcatcaactttcatgagctacatactagaagaaagcgctgagaagttagtgggcattggctacccctggtacaggttgcatggggatagatgacatagatgtaatcttaaggtgggaatggagtgatcagaggaggcttcctgatgcctgtgcaccttctgagcccttgccgatgaatgacaagtggaaaggctaccttgagcaaaagaagaagggagtaggggttcctagcaggaaggtggggttcctgcttggggtttctagcagaaagatgccccagtgccttggcttataggcaaaaaatagcagatattggggaactaaaattggttagcattggctggtgtgcagcaggtactgaagaggcaggtaacagtggtcaggtaatgatgaatttacagatgaaggtgtggaaataaatgaaggccacccacatgaaaacaagcaaggtgtttattcagagcttgctgtagcaaaggaatcagccatcatcactcacgtctggccgagattcaaaggccggcagagccatggggaatccttatagtggggaaaaagggaaaacttaggtgtgttctgattggaggcagttggtggttcactagaagtgaggcatcctttgtgactggttagggggaaaatttgggtttctctgtttggtcctgagttggaagtaggggaaaaattagggaagctcatagttattgatcaagttctggacattttgggctggttgctacagggcttcctattggcttcctggatgagttactacagtttataggttagacctctctctttatatatagtctagtcaccgtccatttgtatattacttctctcaatgataaggatttgagaacatatgctaggaacaatagttatttaagtgttttgacctcagggaatttttattctattacttgtttcgtcattctttctcctgcatcttttcatttttttgcacactgtgatgtgtgagtatcgcattgctgctctcccaaatatgtcattcaagttttttgccttttcctccatggtttttatttctgtattgttactctgagtttcagatatttcttccatttactcttctagttcagggattggcaaatgctttcagcaaagggtcaaatagtaaatgtttttggcctggggagccattcagtctctgttgcaactacacaactgtatcattatactgcaaaagcagtcatgcacaatatataaatgtataggtgtggctgtgtttaaataaaactttatttacacaaacaggctgtgggccagatttggcttttgggacaaaattttatgacttcttttctaggttacttagttaagtctcaacagatgtgtccctgaatcagtgaatacaatgacaaatacaaatgcataatttgttaaataaaattgtataaagtatatgtgtgtgttatatctccctaaatactctgaaaggcatcagactatgtcatctccaaatatgccactttggtgtgagaattatttttagctgaggtggaaggatggcttgaacccagaagttcaagtttgcagtgagctgagatcacatcacctcaatctagcctggatgacagagtgagattctgactcaaaaaaaaaaaaaaaaaaaaagaaaagaagaaagaaagaaagaaagaaagaataaagcaaaataatagaggtgcagaggagatgcaaattccacatatggtcagataaacttgttgaatgagaaacacaattttccaacttagaaaataatgaaatcgaaagttgaagagggtgtattcaccgagaggaagtgggagagtcaatgactggcatttccatgagttcagatggcaggtcctgtggggatcactgagagctggaattgcaggaagagccacttgtgttgtgcgtcttgagtgatgacaggcaaatagtggttctggaagtgccttatggaatcaggatggctggggaggttaatcatggaactgggaggccagtgtgtccaacacgttatgcatgcagaaggggagactctgatggggttcagcacacactaccccaaaatacagcattttggcatttgaaaaaaagaaaacaacaacaacagcagaaggagaaaacctactctcacctatccctcagccctttccctcagccctttcccctgaaacatgttgcccaggctggtctcgaaccccaccttcctgctaggaacctctactcccttcttcttttgctcactgtagcctttccacctgccactcatcagcaagagttcagcagatgcacaggcatcaggaagcctcctctgatcactctgctccctgaagcaagtcaagaaaccggggaagagttctctaacctttccctgaagcaggtcctaggaccttgattcaagaagtgccctgtctatctccagagagaaagaacatctttatttctgaagacacagacacagagaagaatcctaacatgcagcccttgctaggttccccccaccccagtttattcccgttagatcacgccctgttgtccctcaatcacacttctgtgtgatcgcccacaaaaatatagttttctggctggtcatggtggctcacgcctctaatcccaacactttgggaggctgaggcagggtggattgcctgagttcaggagttcgagaccagcctggacagcatggtgaaaccctgtctctacaaaatatttatatataaattagccgggtgaggtggtgcatgcctgtagtctccactactcgagaggctgaggtgggaggatgatttgatccctggaggcagatgttgcagtaagccaagattgcaccactgcactccagcctgggagacagagccagacactatctctctatatatagttttccctgggtctttaggtttttatcctaaaagctcctgtatcacatacaatttatactacgtaaatatgtatgctttcttgtatctggctaatctgtcttttcttatcagggtctcagccattaaccttgcgatgggtgaggaaaagatcttactttttctctcctacaatgtgtaggagttagggagtttataaaccgtgcaacaagactacggaggagacctgaggaatggaacgccctctgaagagttgcctcagaggcagagacaacacagagcagaacggacttggggattgtgggtgggactaggggcatagactatcagaggcaagtgatgaggttactgggtgtgtggcttatctagagaactgctcccagagagtatgcgtttttggggaagcacagggctaaccaagatttgcactctttgtacctcagaaggctttctgggctctggaaatggagcgaatcagctgaatctgtgatggccattctggctccagaaagagactgcatgtccaagttccctagtaagctcctggggaattaccaggatctggctagagacagaagctgcccctcttggtgaccttgagactcgttgcctcctagtattttgcaggacagaaatgtgagctgcctttgtgtcttgctgtgtagggttattttctgcaaattggctgagattggcgtggcacctcccaaaacttcattttgaggactctccccaaagactggaattcccttagcaaagatcattttttaatgcaaaccatctgcttcaatgaaaaagaaaaagaacaagaaaaagaaagaagtaaaaagaaatcatgacctcagttttctgcaaaacagacgaatccttggttttcaccaaaaggcaaaacgctaattaatttttaaaatgctgacctcctttgaattattttagtcctttagatgaaaaacatgtgtcatgattgcatgtgtttttattcttccacaggcttggaactctgggtgtttggggaggctttctatatgcctcaaagcccttaatacctcattgtgaactggcatctcaggttacttctctcatgagtgacagaacaaagacctgcattgtgagcaggggagaggcaagggtgaattttaaagcataaagtggttgaatttagaggcagaagaagttggagagggggagagaaatttacttagtttataaatttgtctggagctggccaacgtatgccaattatatgaccagttcaggtagaagtcagacctagaaaaagaagaaaaacaatatacaaatgaacacatgtgaggtgatattagagcattggcaatggggatttaggggctatggttgattttaagagtgtgtgtgtgtaattggtgatcaagaattattggtactcaaaaataatattaattcacaatatagttcgatttgaataaagagtggcttgtgatagggaggatatataacttacttctccttaagcttggcagttatattgttttctgggggaaaaaaccagtagaggtattttagaatagggtagaaaataaaagtagagtcctgaaagtagatctatgccctcaccacacacaagcatactcctttgtaacacatctccacagtaactatatcttcttcacaaggaattaaatgagaagaaaaccatagactactatgcacacacaagctattaatatcttctttctgcaatttttacagattttctcaacaccattgatttataggatcgtgagcaagaagcactgatggccatgaagatgaataagcaaggaaaagtggtcttagttagtgaaattgatgatgatttcatgtcttctttatcataggggatgcctaagttctacaattcatattatcagatctgatgaattagaaactcatccacttcttgcttgcactagaaaaaatgccagacactgtgaggccaagcaaatcatgactaactaaaatttttgaagaacaggaactccaacacataatgagatcatgtttggttttcccagaattgttttttgactaaatggaaagcaaaaagaaaaaggaatttgttaaagaagctacaatgtctacatcaaagccaaaaatacttggagctctaaaaatacacttaacattttaacccagggggaaacgtttgtctttcaaaagtgaattagggctgggtgctgtgtctgacacctgtaaccccagcactttgggaggcgaaaggctcacttgaacccaggagctcgagagggcaacatggcaaaaccccatctctacaaaaaaaaaaaaaaaaaaaaatagctgaccatgaaggtatgtgcctgtaatctcagctacttgggaggctgagatgtgagatttcacttgagccctggaggtcgaggctgaagtgagccatggtcataccactgtactccagcctggtcaacagagtaaggctctgtctgaaaaaaaaaaagtgaattaggaagatcaatgatttaagaaaataaaatttgactgagatttggggaatgtgcattattcagaaaaaaattgcaaaatgttattccgttgtaaagatatgctggtgttatttaaatattaacattctcaaaggtgctatatcttagaaaaagaacaggaagagtgctttcagggctgaataatggctttggcaatttgaactgatcaaattgaccagatagttaccaaacttcacctgattttgcacgtatatgtgatgaccatgtccaggaaaactggaatgatggaactatctatcatatatatggtagactctatgtccacctgggccactggccccaggacatatactatcatacatacagtaggctgcacttccacttggaggcctggaaaggggacaggtattattatacatatggtagatttcatgtccacctggaagagtgtagccaggacatatactattatatataaaataaaatccactttcggccaggtgcggtaactcacgcctgtaatcccagcactttgggaggccgaggtgggcagatcatgaggtaaagagatcgagaccatcctggccaacatggtgaaaccccgtctctactaaaaatacaaaaaattagccggacgtggtggtgcacccttgtagtcccagctactcggaggctgaggcaggagaattgtttgaaccagagaggtggaggttgcagtgaaaaaaaaaaaaattcactttcacccgaaggactggagccagggcatatactagcatatacacagtaggcctcattttcacccgaagtattggacccagtacgtatactgctatatatatggtaaattccaattccaactggaggatggcagggggcttatattatcatctatgtggtagatttctttttttttaatatatattttatatatatatatttttgagacggagtctcgctctgtagaccaggctagagtgcagtggcatgatctcggctcactgcaagctctgcttcctgcgttcacgccattctcctgcctcagcctcctgagtagctgggactacaggcgccccccacaaggcctggctaaatgtttgtatttttagtagagatggggtttcaccgtgttagccaggatggtttccatctcctgaccttgtgatccactcgcctccgcctcccaaagtgctgggattacaggtgtgagccactgcgcctggccatagtatatattatctgtgtatgttaaacttcccttccacctggagaactgaagccagggtatatattatcatatatatggtagactcctcttccaccaggaggacccagtgtgatgggtaatactgaatgtcaacttgattggattgaaggatacaaagtattgatcctgggtgtgtctgtgaggatgttaccaaagaagattaacatttgagtcagtgggctgggaaaagcaggcctccccttaatctgggtgggcacaatctaatcagctgccagcttggctagaatataagcagggagaaaaatgtgaaaagagagactggcctagcctcccagcctacatctttctcctgtgctgggtgcttcctgcttttgaacattggactccaagttcttcagttttgggactgggactggctctccttgctcctcagcctgcagacggcctatcgtgggactttgtgatcgtgtgagttaatacttaataaacttccatatatatatatattccattagttctgtccctctagagaaccctaatatacccagggcatatattgtcatatatatggtagactccccttccacctggaggactagagccgggacatatattattatatacatgatagactccccttcctcctgcagccaggacatatattatcttacatacagctgtagactcatgtccacagtgacatcattaaatccacccagtgaggttttctactgtagtgttgactgcatggggatttggtcagcaagtccccataacctccaaatctactggatgtcctcccatgctaaagctcactgacttggaaaactctcaagttgtgaaatagattcatataaaaatggaccctccgctccacatctggaattccataattctgaatgtgtcctccttttcaggcacttccttggaccatgttttgaatgccttgcctgcacagcttacctcttccttggacactgccagtgctaccatatttgagatgatgggtcggtcgtttttgttttgcagtggtagtcagggttctccagagaaacagaaacaataggatatagaagtacgtagagatttgttttatggaattggcacacgattgtgggagctggaaagtctaaaatcttcaagacatggtggtaggctggagattcaggtaagattgatgttgcaacctcgactcctaattctgtagggcattgggccagaaactcaggcgtaatttctataccttagtcttgaggcagaatttgttcttctttggaaaaacccagtctttattttgttgttgttgagacagagtctcactctgttgcccaggctggagtgcagtggtgcgatatcagctcactgcaacctctgcttcccgggttcaagcagttctcatgcctcagcctccccggtacctgggattaaaggcaagggccatcaagcctggctaatttttgtattttaagtagagatggggttttgccatgttgcccaggttggaccccagtctttattcttaaggcttttaaccggttggatgaggctctacatgatagagggtcatgtcctttatttcaagtcaactgattgtagacgttaatcacatctacaaaataacttcacagcaacaccaagactggtttgagtaaacaattggataccatagcccactgaaggtgacatataaaattaaccaatacatcccaagggcactcaataggtccagtccttctggtggaagaagagtctaccatatataagataatatatgccctggctccagtcctccaggtggaaggggagtctaccatatatatgataaaatatgccctgggtctattcttccacgtggaagaggagtctaccatatatcaggtaaaatatgcctgggtctattcctccaggtgaaaggggagtctaccatatatatgataacatatatgccctgggtctatcatctatgtatcttatctatcatctatctatgtacctctctatcaatcatctatctatgtatctatctactaaacaaaaaaatcagggctaagcatggagactcatacctgtaatcccaggacttttggaagccaaggcggggggattgcttgagcccaagtgttcaagatcggcgtgggcaagatggtgagaccctgtctctatttaaaaaataaaaaaaaaccttaaaaaaaggaaaaatcaggcttttaaataattagttttattcagtatcttactgaagattgcaatcccggaatctttcagagtttctgttagactgctccaaaacagtgtttcaacccacagcttatacacaggtggtagaagttctgcaggtgctcagaagttacaacaaatgtgctcagaagtcatagaagtcacaacacatgttctcagaagtcacctcagatgtgctcaggtgttgcattagagccagttctcatcaaggtttgagcgccagggaacaactgtgtatagattacagaggcacagtcattaatcctgtcggacattatgtgtgggaaggggcagggactaggagcactgaaaccatcttttctaaaaatgcagcgattcaggcaagagatgtgggaacctgtgctcgatttatcccatttatcgccctcagggcattcttccacagggctgggctatgtcactcagtcagggattttgtgacattcccctggcaaacagaaggcactaacatagcttgttacacttgcgactttgtatcacatatctctctatctggtcctagttcctattggtagtttctctggagaactctggctaacacaggaagcacttcctcctgagaatagcatccaatgataacattttgcaacttatgtatcttacaactggaggaagaagtggctgtgtaaaggagaaacagggatagaatgcccttcaatttttggcttcctgatccctggaaagattggacaggtgagagcaagcatacacaaggaaggatttggatggagacagagaagctttgtctggtgaacatcattttgataaagtaattactatcaatcatgaaagtttaccagccgttaatcaggacgccatcccttttacaaaaaatactgctacaaatatgacccgatgctcgttaaggtcttcattattcttggtgattactagtatcctcatttgcaaatttattttgccagtaaaaaggtgaaggcttacagaggggaacaagtggccccagcgtggccaaatgttttgtctgcaagctggaaatggattacattttcatgtggcctcctgattagtcacagtctcttagaagaaagagggttctgtttatacatcgaaactctctgttttcttttttaatgaatagtttcctttttgttatacagacccagaaagaaaggtgactggactggatgtcaaattttagtcggtctgcttttatgaataaggaatattcataaggcaaagaggagacacatcacatcactttgtagggagcaaaaagttgtttgcaagcgtctctctgagtcaacaagcttcagttagaaagcagtgttcctaactgaagtagattatcacctaaggatgaaaatgaagccacataaaagtattgaatccttgggttgggttacttcagacttctggtcttttttttgtgtgctgacctcccgtggacttttcaggcagcccccacggtgagcaggaagagaaccatggggcttaatcatgcacgaaatcctccatcagtgcaagggctggggaaggagggctattatttgcacatggggaggcatgagcatcattaaactgtttcgctgcagagaatctacatgtaccagagatgaagagtgagagtaactcagtatcttcatttgtaagctaagttttctagtaaaaatacaagtacacaaataaagagcattcatttttcttgttttggtttgctttaagataatagactttatttttaggcatttttaggcttacagaaaaataaccagaaaatacagagaggtcttatatagccttgttgttgaaaaaaagtcaaactctgtaaaatatttgaaaaaatttatactgagtcaaatatgagtgattaatggcccatgacactgttacagaaaaggggtcctgatccagaccccaagagaaggtttttagacctcatacaagaaagaattgagggtgagttcatagagtaaggtgaaagcaagtttattaagaaactaaaggaataaaagaatggctactgcgtaggcagagcagcggtgtgagctgcttaactgcttacacttcttgttattaagacttcttggttatatgctaaacaaggggtgagttattcatgagttttctgggaaaggggtgggcatttcccagacctgtgttcctccccttttgggaccatatagggtagcttcccgatgttgccatggcatgtgtaagctgtcagggtgctggtgagagtgtcttttagccactaatgcgttataattagtgtataatgagcactgaagacaaccagatgtcaatctcattgccatcttggttttggtgggatttggctggcttctttacattatgctgttttatcagcaaggtctttgtgacctatatcgtgtgccgacctcctatctcttcctgtgacttagaataccttaacttcctgggaatgcagccgagtaggtctcaaccttattttacccagcccctattcaagatggagttgctccggtacaaacacccctgataacacaacgttcaggagatcctgaggacatgcatccaaggtggctggggcacaggctaattttatattttagggagacatgagacattaatcaaatacatgtaagatgtacatttgttcaattcagaaaggcagggcaactccaagctggggcggcttccaggtcataggtagatttaaaaattttctgattggcaattgattgaaagagttatcaatagaaaggaatgtctgggttatgatgataaaagattgtgaacaccaaggttttattaatatcatgtggatgaagcctccaggtagcaggcttcagagagaatagattgtaaatatttcttaccaaacttaaggtctgtggtgatgttaatgctaggcagtttttcctgaattccaaaaaggaggagggtataacgaagcttgtctgaccttcccttcccgccatcgcctgaaccagtttttcaggttaacttagaaagcccttgtccaagaggaggggtccattcagatgattgggggtgggaggcttagaatgttttctttttttttttttgagacagtctctcgctttgtcacctgggctggagtgcagtggcgcgatctcggctcactgcaacctctgccccccaggttcaagcgattctcctgcctcagcctcccgagtagctgggattacaggtgtgcaccaccacacctggctaattttttatatttttcgtagatacggggtttcaccatgttggccaggctggtcttgacctcctgacctcaagtgatccactgcctcagccttccaaagtgttggaattacaggtgtgagacattgtgcctggctgggacgcttagaattttatttttcatttataccctctcattctatccattttccagtctcaaattagtgtaatacatttgtcacaattgctaaagcaatgttgacactttgaaccaaaatatctaagaggggtctcagtcaatttagaaagtttattttgccaaggttaagcacacactggtgacacaacctcaagaagtcctgatgatttttgtccaaggtggtcagggcacaacttggttttatacattttagggaaacatgagacatcaatcaatatatgtaagatgtacattggtttagactggaaaggcgggacaactctaagggggagcggacttgcagatcatagtagataacagaaaaaatggttacattcttttgagtttctgattagcctttcactgaatgcaaaatttataggaattagtcacttatgcctcagtctggcttagtgaaacaatagggcagatgaaaccatctgatatacattggtctcacaggagccaagggatgactttgagttccttctgccctttgtccacaaggaatttcctcgtgggcaaattgtgaggaagggatgtatgttcgttatctttgcagttatcttatttaggaatagaattttgtctggattgatgggttcttggtctcgctgacttcaagaatgaagctgcggaccctcttaaaggtggcgcgtctggagttgttccctcctcccagtgggttcatggtctcgatggcctcaggagtgaagctgcagaccttcacggtgagtgttacagttcataaaggtggcgcgtccagagttgttcgttcctcccgtccggagttgtttgtccctcctggtgggttcgtgatctcgctggcttcaggagtgaagctgcagacctctgtggtgagtgtggtggcacagacccaaagagtgagcagcaacaagatttattgtgaagagcaagaacaaagctttcacaccgtggaagggggacccaagcaggttgccgttgttggctcgggtggcctgcttttattcccttatttggccctacccacatcctgctgattggtccattttacagagcactgattggtccattttacagagtgctgattggtctgttttacagagtgctaattggtctgtttcacagagtgcttattggtgcgtttccaatcctttagctagacacaaaagttctgcaagtccccacccaattagctagacacagagtgctgattggtgcgtttacaaacctttagctagacacagagtgctgattggtgcatttacaatcctttagctagacagaaaagttctccaagtccccacctgacccagaagcccagctggcttcacatctcagaatgggaggcaggtttgcccgacacagttcccagcttgacttttctcttcgggttagtaattttgggatcatgagatgtattttcctttcataatacattattttttaactaaagtccatagtttctatcaggtttaccacttacattgtacactctctgggttttgacaagtgcatatatgttactatatcattataacaccattgcagatgtaagatgatccagataatgtatgcagaattgatttagaattccagactgcatgatagtatgtttttgtttggttggttttgtttaagatggagtctcgctctgtcacccaggctggagtgcagtggtgcaatctcggctcactgccaccttcgcctcaaagattcaagtgattctcttgcctcagcctcctgagtagctgggactacaggtgtgcaccaccacccttggctaacttttgtatttttagtagagataggattttgccatgttgcccaggctgatctcgaactcctgacctcaggtgatctgccctcctcggcctcccaaagtgctggtattacaggcgtgagccaccttgctgggccactatgtattttttaaacccccaattcaatttctctgcatcaattaagaaataaatccatctgttctaataaaatacaaagaattgaaggtttcttgttgctcactgtattagtgcattctcacagtgctataaagaactacctgagactgggtaatttataaagaaaagaggtttaattggctcatggttctgcaggctgtacaggaagcacggctggggaggcctcaggaaacttacaatcatggcagaaggtgaaggggaagcaggagtcttacacagccagagtaggagcaagacagagagagaagaggtgccacacacttttaaacatccagatttcccgagaactctatcgcgagagcagtactaagaggatagtgctaaaccattagaaactgcccccataatccaatcacctcgcgccaggccccacctccagcattggggattacgattaaacttgagatttgggcagggacacagatccaagccgtatcactcactgtaaaggaagcaatgtcagagacacgaaggccataagaaaaaacggtgtccctattgggagtgtgctatctattaagaacatacattgataagcaccagacgtttgtaatatacgtgggagcataatgcagtttaagaaaacaaagacaagatcgttctgcaacaccaaaagctggaggattgtcatggagcaaaccgaagttcagggaggaaaaaaagcttttttttattttaaataccgaattatgactgcagctctatttttgacttccatgagaggcaattccaaattgacaaactttgtttcccagttttgagaatggactttacctgtggggtgatggagaaagaggataccacaaattctcactgcatagagtagtgtttgaccagttgagcaaaggaaagggtttagtctctattttaagaaattttaggcttcccaggattttctctaggccttgccttgtttgcacaaacacgataaagcaactgtttcgttgatgtcctggtgaaaccacctttgtaaaattgtgactgagacagtgaaagaggtctaacctaaccaagtccatcttgcttctaacctctaagctgtcctttttcactcctgggcgtaggctgaactaactttgggagaaacttagtttatagtttaaaacaaagatgataacggccctttccaaagcagaccttcttcttgcctggggactagactgcctttttaggactaacattagtgcaagattagaaattgtggtttaggagtcatgcagctggaggctacaagattctggccctccctaaactgctcttaagatcagtgcttgagatatcttgcagaccctgcacttgatggatcagctggcaccacccagatcaataaactggcccccatccaggaaccgattcagctccctgaccaatcagcactcccggctcactggcttccccagacccaccaagttgtccttaaaaactcagatcccggaatgctcaggcagactgatttgagcaataataaaactctagcctcccgcacagcctgctctgcgtgaattactgtttctctattgcaattcccctatcttgataaatccactctgtctaggtagcaggcaaggtgaaccctttgagcggttaccttgggcttcttgagggaactaattttcagctttttggcttttttgtctctctgttggggaggtttcatttctagtctgtgtgaaccctccatcttctgcgatgtcaagcagttgctagggaattagttcatatttattactctggctgcagtttctgtcttcaggtctaggactttgagatttcatttttaagtgactatgttttttaacctgcatttccatgtgtcaatggtaagagtaagcgtgagtgcatttgctcagccacttgtgtcactaggagggaaccacagtgatcatttaaaagataaataggggctgggttcacgcctgtaatcccagcactttgggaggccgaggcaggtggatcatttgaggtcaggagttcgagaccagcctggccaatatggtgaaaccccatctctactaaaaatacaaaaattagccaggcgtggtggcgcgtacttgtaatcccagttacttgggaggctgaggcgggagaattgcttgaacccgggaggcggaggctgcagtgagctgagattgtgccactgcactccagcctgggtgacagagagagattccgtctcaaaaaaaaaaaaaaaagataaataggatggtgtaaaatatcatttccctgtttttaaaacagccatttatagactttaataaagtaggattgattcactcttttacaaaagctatatatatatatatatatatatatatatattttttttttttttttttttagatggagtctcgctctgtcacccaggctggagtgcagtggtgcgatgtcagctcactgcaacctccaccttccaggctcaagcaatcctcttgcctcagcctccccagtagctgggaccacaggtgcacatcaccacccaattaatttttgtattttttttttttagagagggggtctcactatgttgtccaggcttgtctcaaactcccaggctcaagtgattatcccacctcagcctcccaagtacctgggactacaggtgcacaccataatgcccagctaatttttgtatttttgatagagatagggttttgttttgccatgttgcccgggctggtctcaaattcctgagttcaggtgattttcccaccttgatctcccaaagtgttgggaatacaggcatgagccactgcacctggccccaaaccagtatttttttaaagaattttccaaaatgttaacattgactttctgggttgtgagatcacagatactatatgtcatagtatattctttaattatatcagtaattttaccattttgagcaataaaaaaataataatatttgggctgggcacggtgtctcacgccagtaatcccgacacactgggaggctgaggtgggaggactgcttaaaccaggagtttgagaccagactgagcaacatggagaaaccccatctcttcaaaaaaatacaaaaattagctgggcgtagtggcacgtgcctgtagtcccagctacttgggaggctgaagtaggagaatcacctgagcccaggaagtgaaggctgtagtgagctgtgactgcaccactgcatttcagaccctgcctcagtaatacataattacataattaaaataataataatatttaaaaaacacagtggatactattgcctggaaattataagacctttagctgagtatcacatgagagtagccaaaattgattactcaaaattacgttatttggccataggtaaggacatgtaaatttgggaagaatttatgaaaaagagaatgagatatttgatcaaagatgaagatccctgcttctgttggaaaatatcaaagaacaaccggacacattcattgcgattcaggaaaggttttaatgggatgacttcaaagaggaagacatattttcaattgcagaaatggcaagggcacattgttggtgtgaaggcctgagtcggtgggaaataaatgagctaatctaagacactgacataaagcttccaggaaagaaatatggacagtggtgcagtcgtgagaaatgtgtttgatcttgcagaagtggtgtcatttgtgagagtgacaggcagattcacacaagcgcatagaatgcaccctacagacacagagccgacacacctcgcttaaaggggagctggaatttaggatgcataatttagggagaagatgataaaataatggctaaccaaacagcacacacacaaactcacgtgcacgcatggacacacacacacacacacacgaatctactatatcaaagaaaatagaaacagcctgaatttttggtgcacaattttaaaagcagataccgtaaaagtaaatttgagctgcgcgctgtggctcatgcctgtaatcccagcactgtgggaggccgaggcaggtggataacttgaggccagaagttagagactaacctggcacacatggtgagaccccgtctgtactacaaatacaaaaattagcctggtgcggtggttcacgcctgtcattccagctgctccggtggctgacgcatgagaatcgcttggacctgggaggcggaggttgcagtgagctgagatgataccactgcactccagcctgggtgacagagtgagactctctctcaaaaagaaaaagaaaagaaaaaagaaaagggggatggaaaagtatgataaatagagaaaattaatgaaaatgtgaggacctcgaaagctgtatatcattacaggttagggattaactgattaagcaatattcaatctcttttcttttcttttctttttttttttttttttagagacaggatcttagtctatcacccaggctggagtgcagtggtataatcacagctcactgcagcctctaaatcctaggctggagtgatcctcctgcctcagcctcttgagtagctgggactacagctgtgcatcaccatgcccagctaagtttttaattttttgtagagattgggtgggggaggtctcactatgttgcataggctggggtcaaactcctggcctcgagccatcctttcacctcggcctcccaaggctctgagattacagatatgagccactgtgcctggcctgttatttttttaacatatcagttgcacaagactcccacctacagcgaagcaggatgaaaagagattaagctctgatgagaagccattcagtgtggtgtgttaccttctttgtaggatcctgaacagatcaccttatctctagatttcagctttttcagcttcaaaacaaaaagtcggacctgagttatcttgactgttcttactgaaattctctgagtcctgtatgagaaaaaaactacataattttcccctattttgttttgtaatatagaaagagtttcttcctttctattctttgtttagaatacaactttatgttttgttttcaataaatctttgagaatgaggtgttgacttctacgggtcattcaaggtgaattttcattcaggcatttaaaaaaaagaatgattcactcttgggaaatgtcagctgactgagctgccgctcctttttaagtcaggaataagtagtaaagtgcgtttttatacagaatattacctattccatgtaaatctttaataaggcatgctagagggttttaaaagaaatccagacttcatgaaatgagaatatccagagggaaaaatgattgaatttaaagagagagagagagaaaaaaaaagaaggaaccttcagtggtaactgtattcagccaaggggatctgctgatggaattatgaaatccagtttgggaagtgaagtgaactttcccagccaccgactcaaagcacaagatcctaaagtgcttaatgaacagtgaaggctgacctgtgaaggattaggaatttcagacatgtgttacttaagcttctcattcccagaaccaaaattcctcgcaataaaagaaagaaagaagtcagcatgatggctccatcgctgggctgacctcagatcgtgctggtctcagtgatgaacggaaggaatgagaaatcttctaacagattccacatttctggtattgtttttgactcctctgactttgtctttaccccaattaccctgtagcctgatctcactatttcccctgaaatacaacaatttttctctgaaatacaacaatctgtgttaccttaatcagcagatcattgttccatggcaaagtaattattgaggaaagctgtgaaagaaaaaaagactcttgtatatgcctgccaattaattactctgttattgttctgattttcttttctttcttgattttaaccaatctaccccttgttttagggaacggttttgcatggagctgaaatcaaaatttgtttttaaccaaattgtcgttcttcacagaatgtcaatgcaataataccttcaggctcttggagaagatatagtttacaaagggccatttttgtatatgggatcttctcctatacatcttcaacagcttgagttgagccactgcatgcaaactgatgaccttgctaatgacgctggttggttctactacttcactgatcccctttgtcttggtgaatgaatgaaggggtttaagataagaccactggccaatcctgtagctgacttacaaacacctggaaaagtggtgagatgggatcagttatcactggataagcttcatacagaaccttagagaaaatgtcctaaaatctttttaatccagaaaatcacgtttttactgttagattatgtttttgtttaatccagagaattatattttaggttaactgtacacattctatttacctgtactgagtagggtcaaaattatgtttttagtttgttgaattccatgatacttcctcatgctgaattcattgaattgcatgcaaaagattctgaatgacaaccaaaatgtcagctatatgtttattcaaattcatttgtaatgttaattcagtaaaccttttaactgctaggcatcaacctaaggcaatcgtcttctccaattaagaagtatatatgcaaagctacattataattagggagagaatttttgagtttacagagtcataaaacataagtggattgggagataatttttgagtttacagagtcataaaacttaagtgaactgaatgtttcctgactcaaatggatttaagagttcttttctataaaaagaggcgcatgtccttggaaatacagtcttctctcagctgagtagggtgttttctcctctaactcctataaccaatagatatggcagcttggacttaggtcttttatttgctttgtttcatttcattagatgcttgtgtgacacactgcacgtatctggatatgttcacacctccattcaagtcagcatttgttgtatgagtcactgtctttacttaaggcaacgatcactatctctttcggtactgaatatattatattttggtttacattttcccttttgcaattcctcattttcaagttttacatgtaggctgcccatggtctcaaaaaaagcaaataactacataaatgctctgtcttattctcagtaatgacaaccgcatatttgaagatttctggaagattttcctacatggaaatatgtcaatgttgtggggccactgggttatttattcataactatatatctaaaatcaaggggagaggtcagggatgttcttatgagaaataataagaagagtacaatctctgactctgatggtgggtggtgatgttatgatttcagggaaaagtaatctatgaccgaatggtgggtcatgagcatctccatccaggaaaagcaatctatgactgagatgttaagacatgggcatctcagcccaggagaaacagtctatgaacaggacaaagagcgctgatgatcatattcctggttttattagaacaggtctttgcaatgttccactttagcctctagttcaagaatgacttgctgattaacaggctcaagctttcttgacagagtggagtcttggcaaaaatgctgagtagagagtagtagaagcttgtttgggagcctctggtagctgtttctttcagtaatcaggcttcctcaaaaacacaatcctctggcctcactctgcccacgtcagatgtcccacagtgcctgtgctatgtgagcaagtctttcctattttagaaatgtttccttctggtagcacacagtagctcatgtctgtaattctaacactttgggaggctaaggagggagaatggcttgagtccgggaattcaagaccaccagcctgggcaacatagggagacaccatctctgcaaaaaaaaaaaataaataaataaaatagttaactgagcgtggtggtgcacatgcctgtggtcctagctacttgggaagaaaagacaggaggattactcgagcccaggagttcaaaaccagcctgggcaacatagcaagaccccatctctgcaaaaaataaaataattagccaggcatggtagtgagtatttgtgaagctgaggcaggaggatccttgagcccaggagatcgaggctgcagtgagctgtgatggtaccactgcactctagcctgggtgacagagagacaccttgtctaaaaaaaaaagagagagaaatgtttcttttccttactgaggtcaaatcctacatgttccattgttgcttttctgggcatctcccaaatcagtgtaacacattctcattagtggttctggcggttcctctatcaatgtctaggcattcctgcctctaatgctggaaatgcattgtctaggctagccatgaggtgtaggtggtaaaacaaaacaaaacaaaacaggaacacatctgaactgctcctggagtctcaccatgcaaatgctcctacccctctaacaattccacaaccccctactgtatgtagtccattttcatgagctgaattgaagtggacagttctgctttaaactggtggacaggattgaatttggaggaagacactgagttttttttttctctctctctgaatataacgtcttttttttttttttttttcagatggagtctcagtctattgcccagcctggggtgcagtggtgtgatctcggctcactgaaacctccacctgccaggttcaagcaatcctcctgcctcagcctcccaagtacctgagattacaggtgtgcaccaccatgcccagctaattttgtatttttagtagatatgggatttcaccatgttggccaggctggtctcaaagtcctgacctcaagtgatccacttgcctcagcttcccaaaatgctgagattacatgcctgagccactgcacctggccaggatatatgttttctttaaattaaaaaagaatcacgtgaacttcaagttttgaagacaacgtcaaagaacagacacagtccaggactaagcctggagaagagctatttttctcagctctgcaggaagcagtgcacaactacatggcaggaatgggggtctcaggaaacagtaaaggggcccaggtgggatggtgggagaagtttggcacaccaaggaaggctcttggaggatgggcatgagagatgggcatgaatctctttcacctgtcagtacttgcaacatagtctttggtgtctgttttgttttttgagacagggtctcactctgtggcccaggatagagtgcagcggtgtaatcatagttcgttgcagcctcaaactcctgggttcaagcagttgtcctgcctcagccccctgagtagctaggaccacaggcatgtgccaccacatctgactaatttttgtatttttagtagagatggggttttctcacgttggccaagctggtctcgaactcctggcctcaagtgatccgcctgcctcggcctcccaaagtgatgggattacaggcatgagccatcatgcccagctgcccaacataatctttggagttcagaagaatcctggagatttgacttatgagacaaagcaaagcatcattccatattcctaagctgactttacatttggacatacaccctggaacaaagttgacatttaagaaaatacccataaatacaattatctatttattacttacgttagttttgtggaggattcttagcagagcagatgttaagatgtctatgccaatatttatttcactacagagatgtataaaagaatggagagtgcctaaaaaagaaaaggtaatgaaagatatcaaaatagtgtttataagaaagtcaggctgggtgcagtgactctatgcctgtggtcctagtattctgggaggccagggtcgggggattgcttgaggccagaagtttgtgactagcttgggcaacatactgagacctcatctctatgaaaaattaaatattaaacaattaactaggcatggtgacactcacctgtagtctcagctactcaggaggctgaggcaggaggatcgctcccaagcctgggagattgaggctgcattgagctgtgatcgcaccactgcactcctgcttaggggacagagtgagaccctgtctctaaaaacaaaaagaaaaaaaaaagaaattcggcttagtggaggtctttttcaactattatttcatttggaaaaaaacttcactttaatattggtaaataacacacatacatgtagacaaagtttaaattcccagggccagacgcggtggctgacgcctgtaatctcagcactttgggaggccgaggcaagaagatcatctgaggttaggacttcgagaccagcctggccaacatagtgaaaccctgtctctactaaaaatacaaaaaaattagctgggtgtggtggcgggcacctgtagtcccagctactagggaggctgaggcaggagaatggtgtgaacccgggaggtggagcttgcagtgagccgagatcgcaccatgtgccactgcactccagcctgggtgacagagcaagactccatctcaaaaaaaaataaaaaaaaaaattaggtgtggtggctcacgcctgtaatcccagctactcaggaggctgaggcagaagaatcacttgaaccccagaggcgaaggttgcagtgagcagagatcgtgccactgcactccagcctgggagctagaatgagactctgtctcaaagaaaaaaaaattgttcaaattcccaatcattgggaataataataataaatcttcactcttcaagctctggtccttctcttagggatgctctttgtacagagaggattgaaagcatagagtctcatgtccatcctgagagtaacatggcctgagctaccagcctctccacacccctggctgctgaaagccaccctgtgaaacctcaaatctggcttggaattccttctccagccacagatggaaataccagacatgtgttcactgtagataattcagatataaataagttttctaccagaaacgaaatattgtgatgtatgcaattctatcacttggtgtaattaccaatgttcttctttaaggacaacacatggttatggtttgaatagtgacctcctgtcccccaaattcacatgataaaatgctaatccccaatacctgtgaaagtgatcttctttggaagtgaggtctctgtagatgtcatcaagttaaaatgaagtcatttgggtgggtcctaaatccaacgactagtgtcctaataaaaagatggaatttgggctgggtgcagtggcccatgcctgtagtcccagcattttgggaggcccaggtgagtggatcacttgaggccaggagtttgagaccagcctgatcaacatggtgggaccccatttctatattcaaggaaaaaaaaaggatgggggacaattaggacacagacacacacccagggaatatgccatggggagatgaaggctgagataggactgatgtttctgaaaccaaagagtgctcaagatctcaggaaaccaccagaagagagggaggaagcatgagacagtctctccttcggagactcagaggaactgacatggtttggctctgtgtccccacccaaatctcatctccagttgtaatccccataatccccacaggtcaagggcaggaccaggtggaggcaattgtatcatggaggtggtttctcccatatgctgttcttgtgatagtgagtgagttctcacgagatctgatggtattgtaagagtctggcatttcccgtttgcactaactccatcctgccgccctgtgacgaagatgtctgcttctctttcaccttctgccatgattgtaagtttcctgaggccttcccagccatgcagaattgactgtgagtcaattaaatctctttcctctataaattacccagtcttgggtatttcttcataacagtgtgagaacagactaatacaggaaccaaccctgtcaacttttttccatatatatatatatatatatatataatgtgtatatatacacatatgtatttatgtgtatgtatatatacataaaatatgtgtatgcataaaatttgtgtatatatacataaaatgtgtgtgtgtatatatatatatatacacatacttttttttcccataaaatctagaccctgcacaacctgccaaaccttgatctcagacttccctgctgacctgtgtatgtgacattacagccaaacattttctgtcctctctgcttttatagttgagcatctttctaggacaaaactgtaggattattttgcctactatgaacttctggaagagtttatctggatgaaatagaaggaaaaaaaataggagatagatcaaggggtgtgatctttcagcttgcgtcccaacccaggtgatatggtttggctgtgcccccacccaaatctcattttgaattgtagctccggtaatacccatgtgctgtgggagggacccagtgagagataattaaatcatgggggtggtttcctccatactgttctcatgatagtgaataagtcttacaagatctgctggttttataaggggtttcctcttccacttgactctcattgtctcttgcctgctgccatgtaagatgtgccttttgccttccaccatgattgtgaagcctccccagccatgtggaactgtgagttcattaaacctctttttctttataaattacccagtctgaggtatgttatatcagcagagtgaaaacggactaatacaccaggccagtggaaattgtgcaaaggagtttgaactcatcttctttgctttgtgtagaagaaatctcagtatagaggcagaatctgcctccctcgagattaagacagcagggaagagaggcagccccccttccctgaaggcaggtcagaatgaggacatactcagtttgggacccaactttctcaagagaaaaagtcattccttctcccctgggatgaggaaaagatgagcatgagagttgaagaggtttcttgggagaagtggaggggtttctcctatactttttcccctggagagtaaaataaccacactctccctaggaaaacattcatttttttcctacagcacgtcagatctgttaacgaatgttttactttgaactcgggccattgcaaaatcatcagcctgaaagagcggatactcttgcattggaattcactaatgttcagtttgtttacaatgtggctttcctgtccagtgttttaaaattccacatgtataactgaccctcggagaacagttccattgcttagagaacttagcagggtaaccccattgggcagcaggatgacagtagctttgcacactgaaaaagaaacaaaacagattaataaatagggaaaggctttgatgatgagctcaccaatagaggtggagagaagggagggagagtttaaaaagtgctggaggcttctatcctggggctggggagactttgatgaggacacaggctcagttgggttctgtttggcagatacacttaaggaggaactaggaaaaaaccaaaaaggccctggaggcttccaaggaaatgtctctgttgcaatactttggctgcaagatattttcttctgtccccagccagaaggagcaatcctggtgcttaaataaaaaggcatgaaggcccaaagtggctcttgacttgccaaggcagtattacagagaattaagccctaccttagggcatgccaggagcctgctggaggtgtcagtgttactggaaaagaggcccaacccagaccccaagagaaggttcttggaactcgtacaagaaagaattctgggtgagtccataaagtaaagtgaaagcaagtttattaagaaagtaaaggaataaatgaatggctactccacagacagagcagccccgagggcgagggctgctggttgcccatttgtatggtgatttcttgatgatatgctaaacaaggggtggatcattcatgcctcccccttttagagctcatagggtaacttcctgaccttgccgtggcattggtaaactgtcatggtgctggtggatgtatagcagtgaggatgcccagaggtcagtctcgtcggcatcttggttttggtgggctttggccggcttctttgctaccatctgttttatcagccaggtccttacgacctgtatctcatgctgacctccaatctcatattgtgacttagaatgtcttaacttcctgggaatgcagtccagcaggtcttagccttattttacccagcccctattcaagatggagttgctctggttcaaacacctccgacaggtgcagcagagaatgtttacagcagggaaactgttctgtatgaggctatactggtggatacatgtgattatgtatttgtcaaaacctatagaatgtgcaacacagtaaaccttaatgtaaattctgggcttttggggttatgttatgaacccagtgtgtgttcatcattgtaacaaatgttcattgtaacaaatgtactgctctagtcggggatgttcatagtgggggaggctgtttgggaagagggcagagagtatctgagaaatctttgtatcttccgctcacttttgccgtgaacctaaaactgctctaaaaaaacagtcttttaaaaaagaaagaaaagaaaagaaaaagagtgcagacatgttatagcatgggtgatccccaaaagagaatgcttagtcaaagaagccagtcacaaaatgtgtccagagttggttccttctggtgggttcgtggtctcacttcaagaatgaagccgcggaccttcgcggtgagtgttacagctcttaaagatggcacggaccaaaagagtgagtggtagcaaggttattgtgaagaggaggtcgaggctgctgtgagccatgttcacatccagcctgggcaacagagcaagaccctgtctcaaaataattatgataataataataagattagctttgcatagtttatcagacaagaaaactacaaataagtaactacagcacatattctcagagagagagagttcttttgcggggagatgtctttcgtggtttttgttatttgccaactggaaggcccagtaggctggaagaatttaccctaaaggggttcagaggacaagtatactgctatgttctttttaggaggcttttggagaattaattcttcaaatttagagttatttctagtttatgtttttgttttgttttgtttttgagacaaagtctccctccctccccaggctggagtgcagtggcgtgatcttggctcactgcagcctcaaactcctgggctccaacgattctcccacctcagcctcccaagtggctgggaccacaggcatgcactaccatgctaaaaaaataattttttgtattttttgtagagacagggtctcactgtgttgcctagactggtctcaaactcctagccttaagcgatcctcccaactcagcctcccaaattgctggaagtataggcatgagccactgtgtacagccagccgtttttagttatttcacagtaactaaaaagttgattctgaaaatacatgagagtttgcttttaaggtgttggctttgaggtacagttatgcttgctgcgttgagcacacgtgcacttgtattgttacctgaggagcagcaatactaatgtggccatggaaaacgtagaggtggtcttcccaacctaggccacctgccaacaggacccttcttccactccctagggtgggttccctctgtccttcctcccctggttcctgtgaaaatggtcagaggagaaaaaggggttactgtatgggtgcaggatcttctttgctgcgtgttttagggggcgctgcagacatctcagtatggtccatgttctcctgcacatttagggcttcggaggggtgattgccacagctcaggctagagtgcatcacccaaagtaactctcagcctataaactgcacttttacaagcagattatagacccgtagcattggcatgtttgatacgtctgaacacagaactctgatagtaaaatctcaacatgattcttgctggacaggccagttctctctgtgtatattctaggttttgagaaaccacaaccagagccccctggctccacgtccaccatggtttttcccttgaatggtgctcccagaagctttctgggttacacactagtggtgtctctggatttagtcgtgaagttcctggaaaaaattccttttccctaggctactggtgtgagttaaattctactaggagttcctctgggctgtttcacttcgttatttaaattttaaaaaatattttaattttttgtaacttttatgttttttaaatgttgttttagattcaggggcacacatgcagctttgttacatggttatattgtctgacagtgagttttgggattctagtgtacccatggtctgaatagtgtacattgtacccatgaagtaatttttcatccttcacctccttcccacccttctgagtctgcagtgtctattattccactctctgtgtctatgtgcatgcctatttacctcccacttagaagcagaaacctgcagtggctcttatttccatctttatgtccatgtgtacccagtgtttagcttctacttacacatgaaaacgtatggcatttcatttactgcttctgagtcatttcacttagaataatggcctccagctccatccgtgttgctgcaaaagacatggttttattcttttttatggctgtgtagtattccatggtgcttgaatgtacatatgtatgtacatgggtgcacagatgtatgtacatacatgcaccatggaataccacgcagccataacaaataataaattttaaaaatatctatctctatacctctatatatctatacatctatatatccatacatatctatatatctatacttctatatatctatacatatctatatatctatgcctctatatatctatatatctatacatatctatatatctgtacctctatatacctgttattaggttggtgcaaaagtaattgtggctttttctgttacttttaatgtgaaaaactgcaattacttttgcatcaacctaatatacatgtatgcatatctatgtctgtctatatacatacacaccacattttcttgatccaatcatctgctaatggacacttaggttgattccatgactttgctattacgaattgtgctgtgataaacataagagtgaaggtgtctttttgatataatgattactcttcttttgcatagataaaagtcctagaaaaaactcttccatgttttaacatccaatcctgtctcaccaaccgtggctcagaaaccactattgctttctggattagaaaaactcatccagttcttgtggattacacactaggaaccagttttctgcaaaaagcaaactactccagagaacagtcctcttggtatcgttccagttcatgaacagccattgaaaatgatgacgaaggtggtcatttcaacgccagcttgctgtggtttcgaaacagcagagcacgaatgaagcccaactaagccctcggtgtgttaatccaatgatgatgtcttcaccccacatcaccttctttatcccaacaatattcccgaggcaatacaagaaaaaaggtgtatccgtttcctggccattcgtgggtatattttagcctcaaaaggggcatgtggacatgaaaataggctctttcagagtaggggaatttatcttcactaaaaatttggatcttttgttaatcacaatttttttcattcactttgattttttatgatatggaattaaagtatttcatattttgaccactgaagttttggtgcccactgaaattttgtgctcaaagcagttggctcaatttccccaccctagccctgtcctgggcaccactgctggctaaaaattctatttatacatacatatatattatgtttttagacatatagcgtttgtacatataaaaaattatgtatatgtgtatgcatgtatgtacatatatagatggtccctcatttaagatgggttcaacttacagttcattttttattattttttttaagacaggatcttcctttgtggcccaggctagagtgcagtggtgcaatgatggctcactgcagactcaacttgctgagctcagggatcctcctgcctcaacctctcaagtagctggggctgcaggtgtgagccaccatgcctggctaaatttttattttttgtagagacaggatctcactatatggcccagaccagtctcaaactcctggtctcaagcaatcctcctgactctgcctctcaaaacaataggattacaagtgtgagttaccacacctggcccagatattcttaacatttttgttttttaaatagagatgaggtcttcctatgttatccagactggtcttgaactcctggcctcaagcaatcttcctgccttggcatctcaaagcactgggattacaggcatgagccaccacacccagccaatttaggacttttttgtttttatgataggtttatcaggatgtaaccctattgttaaacatgtaaccctattgttaaacaaacagtatctggacttaacgaaggttcaaattacaatatttcaactttataatggttttatcaatgcgttaccccattgtaaatctaggagcttctgtatacatctgtgtatatatatatatatatatatatatatatatatatatacacacagattaaaaattacatatatatacatgttatattttatgcatatacatatgtctatcttatatagttgcttaaaatgttatacataaataaaagatatatatatataaattaaatatcatgtatagagttggttaaaattttatatgtgcatgtaaactacattttatatatatatatatacactatatatataatattttaatattatcgtcagctgtggtgcctagggcagggctagaatgtctaatgacacaatctcatcaggcacaaatttcaggaggtaccaaaaaactgaaactaaactccatagtcacgatactgataaatattcaagacgtatataatgttttaattatacacacacatacagacagtgctaagagaccattagcttttttctcataatttagacaaaaccacttttgcagtgggccctgctgtgaaagtaaagggttaatgttgctcaaagaggggtggggcatttgcccccagctcctgagaggtgcacactagccttggaatgtcctgcctagtaggaatgtgtttatgtactgggggacctggggtaactggacaatctagcaatgtgatttagggtagagggggctattcatagcagagatttttagagtatgagatggacatactaggtgttaacaatatggttaagggtgggagctttgggtcttgaagtatcagctcagacctctggagaggctacagattgaggtcaactctgtgggccattgactgtggagccccagctgaagactctgaacactggggtttgggctagctaccctggttggcaatgcttcaggcattctgcacaagctaagactgtgaggctccgtgctgtccacaactccacaaggaaaggacagaaggagctctgtgtctgcaacttttcctggattctatctgtcccacatccctcttctcttggctgctatgtcaatctgtatccttgccacgtaataaaccataaccatgagtgtaatggtgaggtctgtcatcctatccaaagagccaaactgagggttgtcttggggaccccaaaatttgcagttgatgtcagaacagtgggtggtcatatggggattgtcccctctaacaatgaacttgaccaacccttacacctaccctgtcttagttggaatgcatgaaatggagactttagacattcctttcaatcttggatgttatgattttatcaaaacaaagtctattatttttctttgcaggtgacagagagagagagagagagagagagagagagagaaagaaacagagagaaagaaaaagaaaaaaaagaaaaagcaagtaagaaaacatgagattgggcaagacagagcccatctcatttctctgtgatttggaggtatcgaataagattctaataagaactgtgtggtatgattggaattcaaactatcaaccttgaagttgatgacagtgcataacgggcttttggtttgcacatctttctggtaatttatcctctttagttccttgtctccacacatctgcttgtgcttagatccaaaggaagagacattaggaggctataatttatttttcagggaggaattaggaagtgaaccaatgtcccattacatttgcatcagtttttgattaaaacacacacacgccacacacatttctcacactgtgagcaccccacactcttgtgtgggtatttttgttgttaattaaatttgtttctaaatagacttccatcctaacctggctttcatgcttagaaagacaagtgataaactgcaataaccctttcacatactttgatacaaatggttttaaacagttgggaagattaagaacaaagaaagcttttaaaaaaaatttctgaacctccaaaggttttgaccatttcctcattattattttgtctgctttgcacatgatgaaatcagaaatgggttataaggtagaactgtagttctgactttccaagaaaaatagtggacaaaacctgaagacaattttcagatgcaggatttttgtgggtgatgcagtgtgcgagggttatggcaccattaatccttgtactgtgggctggtgggggccagcatggtctggcgattgccaggtggattgaaaccacagtctcagatttcagggaatggcttctttcagtaacgcctacacccacatgccatgtggctggaagagctgcggaggggcagaataaaccattttttaatttgctgccttgagaaagatgcacacatccacttcaataccatcgtttttataaacccaggcaaatatttcagaagtgtgtggagcgtaggcgacaagttgcattcatggctgagttactgatgttttaatagagccaatgttgacttggcataatttttatgcttcataaacacaatttattttaccgacaaaatggagtcctgcaacaattttgctctggaggaatctgctgggtgaagcaatacaaattctgagcctcttgcattgaataaatcttggagatttgaaaattcttatgatttgaccatttttattcattcaaaaaaaatggtggcttatgcctgtaatcccagcactttgggaggctgatgtaggtagaacacttgaggtcaggagttcaagaccagcctggccagcatggtgaaaccccttctctactaaaaacacaaaaattagcaggtcgtggtggtgcatgtccgtaatctcagctacttgggaggctgaggcaggagaatcgcttgaacccaggaagtggaggttacagtgagccgagattgtaccactgcattccagcctgggcaacagaacgagattctgtctcaaaaaaaaaaaaattgccacataaacataatcaagtatttgtttttttttcacaatggcgagggagacatttccaacacagcatgtatcttttatatttttactggcttctgaatttttcccacaacaaagacatcttgttagactctactctcatgaaagtatattatgcttgacaaggtgccattgaagacctttgcagctgtatcattaaatgatacatttattacaattcctgaagtctctgcaacctcagatacaataacctagcacattggttgctcaaaagtaaattgacgtccaaatgctgagttagcactttgagaagattacttattcgttaatcttagaggggaggacttagttattggcattcataagcgtcctttcaagtaatcaatgcagcattttgacatgaaaaacggattatggaattttccatgagaaagtgtgaagaaggatttgattttcttaagtgcatctaaagaagctaacattggtttggaatcgatcctcttaaccacaaatatgattgctttattacaacttagggaaattaaaagaaaaataaaatacgtctcccaaaacaatagcatggcttgagagaaaatctgagcgcaacaaatttcattagtcttctcaggttttgaatgacttcttaaatatttgaatcttcattagtttattactgtggttgggaaacaatgcctttataatgttaattgagcacactgtttctggaattctgtaagctaagaagccaagttggtggaggatgacatcttgcaaatgactcaaggagactggacacaaaaacattcatgcattagaaatcaggggttcaacatgcatgcatatgttcattgcagcactgttcttaatagcaaagacatggaatcaacctaaatgcccatcaatggtagactggataaagaaaatgtggtacatacgtaccatgagatgcatatacagccataaaagagaatgagatgctttgctgggagatggaaggagctggaggccattatccttagcaaactagcacaggaccagaaaaccaaatgctgcatgctctcacttgtaagtgggagctaaaggatgagaacacatggacacatagaggggaacaacacacactggggtcttttggagggaggagggagaggatcaggaaaaacaactaatgggtactaggcttaatatctgggtgacaaaataatctgtacaacaaatccccatgatattagtttatctatgtaacaaacctgcacttttacccctgaacccttaagtaggccttggcatctgttgttcccttctttgtgcccatatattctcaacgtttagctccgcttctaagagagaacgtgtggtatttggttttctgcgcctgtgttaatttactaaggacaatggcctctagctccatccaggttgctgcaaaggacatgattttgttcttttttgtggctgcatagtattccatggtgtatatgtaccacattttccttatccagtctaccattgatgggcatttagattgactccatgtctttgctattgtgaatagtgctgcaatgaacatacacgtgtacttgtctttatggtagaacaatttatattcctttgggtatatacccaataatgggattgctgggtgcaatggtagttctgttttaagttctttgagaaatcaccagactgctatccaccagtggctgaaccaatttatattcccagcaacagtgtataagtgtcctcttttccctaccacctcaccagcatctgctggtttattttattttatttttatttttttaactttgtagtaatgaccattctgactggtatgagatggtatctcattgtggtttcaatttgcattttctctgataattagtgatgttgagcttttaaaaatagatttgttggctgtttgtatgtcttcttttgagaaatgtcctgttcatgtcttttccctactttttaatggatgatatggtggggctctgtgtccccacccaaatctcatcttgaattgtatttcaaattgggttgagggagggacctggtaggaggtgactgaatcatgggaatggcttcccccatgctgttcttgagatagtgagtgaattctcatgagatctgatggttttataaatagcagttttccctgctcttgctctctctcctgctgccttgtgaggaaggtgcctgcttcccctttcccttccaccataattgtaagtttcctgaggcttccccagccttgcggcactgtgagtcaatttaatctcttttccttataaattacccagtctaggatagtatccttatagcagtgtgaaaacagagtaatacaatggagttatttgttttttgcctgttaatttaagttccttttggattctggatgttagacttttgtcagatgcatagtttgctaatatttccttcctttctgtaacagcctgttctgttctacagatgagtccacaattctacatctgttggggaataatgaagagaaacaaggggcacattatttttcaccctgtatggaaactatggtgtacttcttgctctttcaccttcaggcaaaatctgataaaatgtatcagaggacatttagttgcctagaaaattatcttgctcctccagctgtctgagatatataatgagataccaactcacaccagtcagaatggctattactacaaagttaaaaaaacaacagtagctcataattaacttttatgcaaaacataatatgaactccattgagattgaggtgaaatttttaaaattgtcatttttatgaaacctcagttcttgcacagtttgtatttcttttgagtactttttttcttctgtggtttggaaatgtcttatttgtttgaaagattatatttgttctctaagatgtagaatgattccacaaaagaggtggtgcagttaaggtactggtcaggaatttacactcagtggtcatgagtcttcactttggaatatgtttaagtgttttaaaaatctattatttgatgttagcatgtattatctcatctaaagacaatatgctgaaattattattgggcaaaggactttacaactggaagaaaaggggaaggaagggagggggaaggagaaagaaaagagagttaaaggaaggaaggagggagggcagaaaggagggatggaggaaggaaaaagaaagaagggaaggaagggagggaggaaggaaagaggaagaaagggagggagagtgaggaagaaaagaaaggaaggaggaagaaaaaagaaagaaagaaaagaaagaaggaaagaaagaaaaagaaagaaagaaagaaaggaaggaaggagggagggagagagagaagggaaaggaagaagggagggaaagaacgagggaaggaaggaagaaagcaagaaaggaaggaagaagggagggagggaggaaggtgatgatgttaaagagaataagaaagaaaccctattaccacaagaaccattaacaaatctaattttttttttttatcataggaggtgctggccattccaggtaccatgaggccaatgaaatcaatgttctgtcctttccttcatggtactgactgaagatctttatctgatgtgttggatcacaggcacaggcagggacaagagacaacttctacacatgtcccagcctctgcttcactgggaacaagaagttgctctgaaggtaggtaggagaatagattagagaaggatgggcagccataagagaaacaggcattgatgtggttgaaatgtttttaaaaatatgcttatgctgtacacacatgttcacagaagcatccttcacaacagtcaaaaaatagaaacaaccaatgtgcatagacgaatgaatatgtgaacaaaatgtgatccatccatacaatggaatgttattcagccttaaaaaagaagagaatcctaacatattctacagcatggatgaaccttgaggatgttttcctgagtgaagtaagccaaccacaaaaaggacaaataccatatgattcctcatatatgagagccttagagtagtcaaattgttaggggtagaaagtagaatgttgattgccagaggccagggggagaggaattggggcattagtgtttaatggggacagagtttcagttttgcaacatgaactgttctgcagatggatattggtgatggttgcacagcaatgtgcctatacctaataccactgaactgtgcacttaaaaatggctaaaagagtaaatttcatgttacacatattttacacaatttaaaaaaatgcttatgatgtggagtcaatagtcatttttgagataattttcaagatcaaaatgaaaaagaagaaatccagtcatcaggattgagttccgaactgatcaactgggtaatgagatgaagaacttatttatttttacctcaacagctgggccacttggcttcttcctgacatttgcagagagcatctcactgtttcatttgctcctggtaaaaacccctagaactctttctagacaaagcaggaaccaccctggggtggtgaggtggggacttctatcatgggagttaggacaacaaggagacagaagtccaggatgaattcagatctcccccgtggacttagagggcaaaggaaagttggcttcgatctgtggagtaatgcgctctaaaccctgtgactccagaagaacaccctcttattttggctgttgtggtggttctgagctgaacagcctgcctcagcccttacctagagggacacgtagagttagataggctctggtttgcagagtctttcgctgggctgtctccccatcagcaagagaaagagctctccaaaactgccagggaagcctgagcctcctaggtgttctaatctgcctagaaaaataattccacaatgtaagtaaaccgccagatagttgagggaaattaacagtatgaaccagttctaaaatgaacaaacagaaggtctgactctcatgagaggtgcaaggttggagataaccagttccatgcataattgtgtctttccacaatgtcagtcttttattgacgctattgcaattacaaaggccacaagctgcatggagttcccaaggaggcaattctccttagtgcttcctgttcacttggtagtcagagctgcgggcacacaggttcaagccactccacatgtcagttgatattgcaaaccatacataatgattatatattcaataaataaatgttacggattaaacattccatggcaaacaaagtaacatggaacatcaagaggaaaaagagataggagaaatggctaacaaagctgggctcggtgcctcacacctgtaatcccagcacttttgagagactgaggtgagaggatcccttgagttcaggagtttgagaccagcctggccaacatggcaaaacactgtctctacaaaaaaaaaaaaaaaaaaaaaattaaccaggcatggtggtgtggtgtgcgcctgtagtcccaactactcaggaggctgaggcaagaggatgtcttgagtccgggaggaggaggttgcagtaagcaaagatggtgccactgctcttcagcctagacaacacagtgagacccctgtgaaaaaaaaagaaagaaaagaaatggctaagaaaccagtctaaatagagtgatgtggacaagaagaatgtcatggtctgggcctggctgtgcatcagtctcgcaaggcaaaggctttgatgtggcacagcctttggtggctgatgccaagttcttttcaggagtgacagcaagacagttgtcagttaagacaactgttttgagttgctgaagtcctgctctttttatgaccacagaatcctctgttgagggttgatggtagaagaatgtgcttggttatgtccttatctggttggatgcagtctttatttttttgtttgtttgtttattaagcaaaacctcttatccttctttgcacagggccctgtgaaacatcaaatggagtctttttctaagatgcagttagttatgccaagggtgtttgatatggtttggctgtgtccccatccaaatctcatcttgaattgtagctcccacaattccctcgagtcatgggagggagctggtggaaggtaatgggatcatgaaggcaggtttttcttgtgctagtctcatggtactgaataagtctcatgagatctgatggttttctaaacggcagttcccctgcacacgccctcttgcctgctgccatgtaagacatgcctttgctcctccttcaccttctgctgtgattctgaggccttcctggccatgtgggagtgtgagtccactaaacctctttttctttataaattactcagtctcgggcatttcttcatagcaatatgaaaatggactaatacagtgctgtatacaagaaccctcctggaagaaatgtaggtcatgcagaagaaacaaaaagaattcagagaactgaattagtaccctgaagcctctgcactccagcctgggagacagagtgagaccctgacttgaaaaaaaaaaaaatgccccaaatgtcagtagtattgaggttgagaaaccctggatgagattcataaaagccaatgtctccttagtaagcatttcaaaacatagaggaaaaagacagtgattaaaagaatataatccaagaaattatgtgtgtatatatgtatgtaaatataaatgtatattttctacataagtataaatatataacattaaacttaattatttataaatatgtataatttctttgaccacatatacatatatgtatatgtctattttataacaaaatctattaattttatgaatataaataaaacatttaaacatgattagatatgcaactttataaatattaacatttaaatacatctatttctacaattaatttacagtagacccctgagcaacacaggtatatgaggattttcctccgcctcggccacccctgagacagcaagatcaatccttcctcttcctcctcttcctccacctcctcaatgtgaagatgatgagaatgaagaccttgatgatgatccacttccacttaatgaatagtgaatccatttcctcctccttatgattttcctaaaagcattttcttttctctagcttgctttattagaagaataccatatataatacatataaacatacacgatatgtattaatttactgtttataatattggtgaggtttctggccaagatttcttcccagttctgacattaaaaaatgcttcctgaacacatgttgttcaaggatccactgtatattaattatataatgtatatatttataaagtataaattaatataactatattatgaattaaaaatttataatataataaagtaataatttatagaaaataataataaattcataacaaatcaatattatgatattgtatatcaatatgtaatatagtatattaatattatattaatatattatagtataatatttaaatattataaattataacataactgtatattaattataaaatgttttatatgtatgtacatgttaatatttatgtagttatatagctaatgtttacatgttttatttatatttataaaattaaaatatttcattataaaatagacatatacatgtatgtatatgtggtcaaagagattatatatgtatatatgaataggttgtttgtatttaagttttgagggagtccagagttacaggtggatcttcaactgtgcaggggtcagtgcttctaacccccccacattgttcaagagtaaactataataattaatatattgattatacatcatatatttagtatatattaatagatacataacttacggaaaacatccacttacatctttgaattgaaaagtgttactaaatgatactaagaaaaaaacatgctaagaggctgactaccatagattgcagaaaagtccaccattcttatgacacaatgcatcaagaggtagagtcgcttccctctccactgagtgtgggcttgccctgggatgtgctttgaccttgaaatccggggaaagcaaggtcatgctgattccaagccttgctgcaacaggtttgcagcttcctttctcgctgaatttggaatccagccaccatgtgaagaagtgcaaccccacctgctgtgtgacgagacaagggacacatttcccctattctcccataagcggggccacctagctgaccagcctgctgaccacagaaaagtgagtgccccactgagccctgcccaaattacccacccagagaactgagagctaagcaaatcagtgttgtttgaagccactcaaattcagggtggtttgttactcaacatgaactaactgttgcactggtaccagtgaagatctttcttctccaagatgaaaataaaattaagttacccaagttgcaaccacaatcagaaatcatgaaacttctcaacagcaatagtggatgctatgagacaatgttgcaaggcatgcagcttcctgtgagaacaatatttttttcttctagaattccaaatctggccagacttgtgaatcagtatgagggaagaaaaaaggaagagtttttcatctgcgaaaggttagaaagttttcattccaaagctcttttctgaaaacaagacaaaacaaaaagtaaatacttgatatattccagattaagaggaaataagtggtaaaattcaaaaagcagctggattaatccacttggattaaggtagaacaggaaatcacagggctcccagaagaattttgtcagggaggaattgcatatctctaggctagagggggattcaaaagtttttttacgtagagatgaaagcctgtgcttcttcaacaaaaggaagataatctctgggaaagaaaaaattacttgctgttcaagaagcaaaccaaaatgtggtaggtcttttttgtttttttattttttcaatgattaatcaaatgtaagaaacagtaattctagaaaaaaacaaaacaaaacagaattcttccttggccaggcaattcccaaagaaagaaaaacccctttgaatatattaaattctctttggattaatagcagagtttcaattaaaataatttcctcgtgttgggtgtagtgatttcccactttattagatatattaaattttcttagaggatcatcttcagcctttaaatattttcttctttaaaaaaagtttaaagaaatttttttcttcaactttaaaatttaaagcttttaattttttcttcttttttaaaaaaattttaaccgagtgcttgttggattgtttatttagatatcaattcagccttatagttttaaaatcaaagataaaaactgtattttgctttttgaaaatgctaagctcataaaacattgtatagttttaaaaactcactattttcagagttttaaactttttttcttaacataattgtaggcattgttgttttccttagcaacattgattactacatatctcattttgtgatattcagtttaggtatttttctttccattcaataacatatattttcctttaaaataaaaaaaaacagcattaacagttataatttctgaatgaagcaatgagggacaattttaattttcttcttatactttttgatttcatgaattttgtctataatttttcaactagaagaaagcaataatcaaaattgcatcatggaaggtttccattgtcttagagagggagaattgagtttacctctggggcagactttcatctggcatctaacttcccattgatgaaatgcaggctccacgccaaacgtgagtctatctcccttatgtaaaagggatgcaatgagaaggggtttggggtgcaggctggactctcatgactttgcagggacctcaaccctaatgatgttgccaacaccataatcattgctgttgctcttggagcttccatatttatttgctagattttcatgcacttatttctgtgtcaaattgtctcctggcttcactgtttcctctgctagaccatcaatgttgtctacagctgtatttctggtttcatcttttaatgagaagaccattgttaaagcaatgacccatggtgtatgatttcccagtctagaggcctctcccaagctcacttttcttgaggtctctctcatgcaatgatcaatcatcactgtcctgtttgttcttcttgacaaatgatcactctttggctgggcatggtggctcctgcctgtaacctcagtgttttgggaggccgaggtgggaggattgcttgaggtcaggagtttgagactagcctggacaacgtagtaagaccccatctctaccaaaaatattcccaccctttgtcattcagtccaagggatgctttctctgtacttatcttccaacagccacatctctgtccttgaatgaatttagaccttctgtttttatctgacagcacattgtggagaggctaaacatcttatctaaatgctgcagacaataaaaagtctagaaatgaattcaatgctgcagtcggcatgatcaatgtggttgtcacagagctcactattggatgtgcctgtatctggttccagactatagggtctgcacaaacaaaaattatgtttgggatgatttggatttcttccatcagttctagctgaaactgacgtaaaatatcaacctaacaaattcacacaataaggatgcacgtgatgagaaggtactaggcatggactgatgagactctggctcttaatgttaattctgcctacatactagctcctctgatgctctttagatagaaaccagatgtcccaagcaagtctgacagtatctgcaggtgacaacaaagagagagggaacattttttttttcttttgagacagagtctcgttcttttacccaagctgcagtgcagtggccccatcttggctcactgcaacttctgcctcttgggatcaaatgatcctccagcctcagccttccgagtagctgggactacagccacatgccactgtgcttggctaatttttgtattttttctagaaatggggttttgccatgttgcccaggctgttctcaaactcctgagctcaagcaatcctcctgcctcagtctcccaaagtgctgggattacaggtgtgagccaccatgcccaggtaggagaggaaacatttgctaatagcacctgatatggtttagctgtatccccaaccaaatctcaccttgaattgtaattatctccatgtgttgtgagagggacctggtgggagatgattgaatcgtgggggcgggtttttcccctcctgttctctttagagtgaataagtctcacgagatcggatggttttataaaaaagcagttcccctgcacatgccctcttgcctgccaccatgtaagatatgtcttgcttccctttcgcattctgccgtgattttgaggcctccccagccatgtagagctgtgagtccattgaacctctttcctttataaattacccagtctcgggtatgtatttattagccgcatgagaacagactaatagagcaccccagaaaatgtaaccttatgtgtctttagacaaagtggtgttgtatgcctgtgctcaacccacacgtggcacaagaaatggaaccgctcatggttagctttgatcgaccagcatctgatcaaaagcctctcttggaatatatgacctcagagaagtagaatgttacccctccaaataaacttggaccctgccagcaacaattatgtagaaacaggatgtaggttggtatcagtggctcagtaagagtttcccaaatgtatgtagtatcgtatcctcaaaattatactcatgtacaattactttgctgaggagctacaaggaccagaacacccaagctttttctaggacacatacagttgactgggaagaatcaacagagcttcttttttttccttctctatttagaaattctttgacctatttccattttctttcttgtgtaacctgttaatattagccagaacttctgtcagggcgcttgccttgggtaatttcgaaatactgtgcatccaacatcatgaaaattgcagttcatattagcttgaataaatgtagtccacacagagagggaacgttagtgctggaattcctttgagtcccatttccacagttcttggatctttaaatccatttggtttcaatgatagtcactatcttttgtcagaaccgacgtttaggcagctagcccagctctgaggtcaggctttggtgcaaagataatgggagatgaagattcaaatttcctttgtatgaaacatgaaccctttagcaatgtcctatgactttctatagtgatttctatttggtcacattttgcataggcaagaagaatctctatacttcatagcaatattatctttggataaggatgggggcagagttcatcttttcaaggtttgaaagaaaatgattttctgcttctaagtgaaaattcctgctgaggtataggaatagccttatcacacatagtaatacaaaaacagtacttcacgtgatcagaaaccccccaagtaattccatctttatttgtgtctcaatgcttgagattaaattatgcaattatttggatattttgtgtttaaaaattgaaggaaaaattggattttattgtcagtaaagcttgttagtctacaatgttaattgatacgtattgaaatctcagttatatgttacatatgtggtcatatgtggtacatgttagagaccataaaaatacaatctgaatgtttaaaaaaagaaagctgcaatatattttaattctgggaggctgtgggttatgttttataactctcccaaattaatcagggtccacattgactaaatacttgtgggttaattatttccttatatccttattattgtttttacaggcatattttctgctttcatgtgatttctttataactcctgataaaattaagcacaagataaatcctcgatgtaatgactaggagttcaatggagtacaataattaatacctgtgtccttataccttatagggtgtcctatttcatttttttgaggcagagtctcactctgtcgcacaggctggagtgcagtgacgcaatcgcagctcactgcaacctctgctttctgggcgcaagttatcctccagcctcaggctcccaagtagctgagaatacagccatgcactaccatgcccagctaatttttgtatttttagtagaaatggggtttcactaggttgcccaggctggtgttgaactcctgggttcaactgatccgcccaccttggcctctcaaagcactgggattacaggtaagagtcaccacagctgtgtcttattaaatatccattatctttaagcttagttcttttttcatctcaggtgggaatattgtataacatttatcctcattagttcttaagtttgaattaagtttgaataaatttaaatacatacgtgtctatactacctagtttagtgagttgaacattgacagcctgttttcttgactgtaacatcctgattattgaaggaggagaactatattatcatatataaacctatatctcaggctctgcgattttcccctctcttatttgcagtagaaataagtataggaaaatcagagatcgtgacatattgacatttctgtgggctccactgtgggtgagcattgttgaatgcgttggaataagtggcttgacttttccatcatccacccagggtgatgagaaacatgtgctatttggaggatgcatgtggcatgaccgaggctcagaaccgccatagggctggtgatgattggttggttgtcgtcttttgttttgtgctcttcccctgagaaaaacagagggcaattgaggctctccacttctaagttctcatttaatggtacttctctttgaattactcttctaaaatgtcaggtttatggagccaaggcaacaatattttaggatccttctgtctctggaaaagaaattaatttttgatctgaaatgaaagcactgagtatttaaagtcaggagaaaagaaaatgtgaagtgactcatgtcccctgggcattggtaacagtccacccttggtttctttcctagcaatatggtggccatattttcccaaccaagctcaacccacacaccaagggcctgggagggtatgggagaaagacagatgttaaagccaggaaaactcacattggaggtgttgtcctggaactcatcttttatttctatgccatttgctttccagttaccctttaaacctgcatctcctcatctatagagtaagatttgttatatgtgcttgctactttttgttgtatgtctgatgtgacttaggattcaataaatgcacgtcttcattcctttctcttcctattccatctttctcttctttgagcaattcccatctttcctttttttctttttttcctccatgtgggtaaaatgagaagtttcttttttattttctttttgagacagggtcttgctgcatcacccaggctgaagtgcagtggtgtaatcacagctcactgcagcctagacctcctagactcaagtgatcctcccacctcagcctcccaaggagctgggactataggcatgcaccaccacgcccagctaattatttttaattttttttaagagatgagggctcactgtgttgcccagcctggtcttgagctcctgggctcaagctcctgcttttaagcaatcctcccaccttggcgtcccaaagtgctgggactacagatgtgagccaccaagccctgcctgagagaatattttaaatagggattgatctaaaacgttttagttatgtggccctcaaattagcagctactctgtctccttggcaggaaggagtttgggagaagtcttttgggttcctcaccatcaccatatagacccctgcccttgggctagaaaacatttatgaactgattttttataaacctaggtaggttgcatattatatttgaggatagagccatgcttataactggacccaaagagtttagcaataagcaaatgtgcttctatagagtgaaaatctcaactcaggcaggaaatgttctccacatcatagtcataaatagcaataagaaattggccctccatctgctgtacaggtagggggagcattgttaaaaattaccagctatgcttatcacatagtcctcacctaatagaaacagagagatttgcttttgattcaaccacctcctagagatactaaaatccatggatgctcaagttcttgatataaaattgtgtaatatttgcatataacctgtgcaaccctcttgtatactttaaatcatttctagattacctataataccgaatgcactgtaaatgctatgtaaatagtggctatactgtattatttatggaatgatgacaacaaaaagaaagtctgtacttgtttagtacagatgaattattttttttagtatttccgattcatgagtgtttgaatccacagaatggagggctgattgtgtaattacttcttgctattctctttttttttaaattttgaaccttctgtgggaggattgcttgagccaggagttcaggacctgcctggacaacatggtgaaactctatgtctaaaaaaaaaaaaaaaaatccagcagagaggtacacgcctttggtcccagctacctgggaggctgaagtgggaggattgctggagcccgggaggttgcggctgtggtgagccatgattgcaccactgcactccagcctgggtggcagagacagaccctgtcttaaaaaaaaattagatatagtctgataataactacaacatccctctgttagatccctaagatctttttctacattattcagagggaattattttgttagtagccttctattaatttcttaaagggcacacacgcacacaaaagattgaagaaggttaatgctagatccattattttaagtgatttaatctattcctttttttctctccagaccgtctcactattttccttctgaaagcatcactagtgaattcagtcacaggtacgatgccatcgaaaacaacgcatgcaattcatgcaaaataaattgggaaagccaggtggggaagtgtttgttgttcctgccagcttatttttcccactgtttccagaaggaaaatgaaagacggggtgaggtgttgcccaaggcacatcccgtgtcctggcttcattctgttcattaccacccacctggtcccccttagccagcccacagtctcctggccacacaagcttcatccaaaccaccctctgtcagctgttgcccttgtcacagccgtgctgctcttcctgtttccccaacacctagccagggcccacttgtcattgccactgtttctctctggtgctcctggtctccgacacgacctcagatgccctttgccacggaggaggaaggatgccttgcccaagcgtacaagacgtgaaacagcttcaccgctatgtcctctccatttctgggctccttttctatcttatgtttgccccctactcacagcccttccccattaagaaccaacctccaaccgcatgccagttgcaacatttctgatgatgaagtgtcaccgaagtgggcctgattgaagaaggtaaggaattggcacatggaataagaatttcaagtgttcataacaagaaggggagggtttttttttcttttcttttttgcaaagaattaataatgaaatggtgggatgcctctaactacacactttggcctcaccctgcattaactcctgaactcccagctatgtgcctgccttctccttgtactagagcctatgaacacttcataaggaagaaaaaatcagagcatccttagccatgctgagaaacagcaatgttccaagctttcctaaataggcacatagatatgagatatctatatctatctctatgtctatctagctatatatctacttatctgtctatcaatttatcaactatcattttattcgatcacctatttacccatctatcttctatgtatcccatctatctatccatctatcctatatatgtacctatccatctatatctatgtatctcatctatctatccatatattatatctatgtatgtatccatctactctttctatcatctatctatctatctatctatctatctatctatctatctatctgattcgtccttccatctgtccatccattcatctatctctcttctatccatctattatctatccaatcatctattaactatctcatctatctatctaatcatctacctataatctattgactcacctattatccttctcacctatctatctataatcaatatgccattcctagaaagtttcaaagggacaatttggaaatttgcaagtgttctctccactaaccggagaagtcagaatgggatgaaaccttcctttgtggcaactaatgagctgcctgacttcttggaaggaaaatgcgggtggtaaaatttattgtggctcaggcatagtgcataagccatcgctcaagaaagaacgacatttttctggaccacacagcctcatgtcaaatgcaattctgttttccaataatcagcatttgtaataagcatctggtgaactaaactccacctcagagcctgctttgaagagaactcaaccactcccaagtccaatctgcctctcccacagtccacctcacacactgctttctctcctgctaccccataactggagtctctcgtgtctccctacattctgatttgccatatgggaactgctgcatctgggttacaaattctcccattccttctgctgtccccaacttaaagcaagccatttccccagtcatctatgacaccttgttcataaccagctctgaattccaaagtcatgtattcagttgtaactcatgcacatcttctctctttgctcccagatattctctctcttcttttctaaatttctcttttaaaatccagtttaaatccctttagagttttcctctctaaagcatcccagagtaagctagtatctgtaccacatcagctctgaagccatataataaagtatagaaaatgaatcaatgcttacatttttcttatttttcttaaaatatgtattttattattagtttatatggctatctttattatttttaagacaggatctcactctgtcacccaggctgagtgcagtggtaccatcacagctcactgcagcctcacactctgaggctcaagcgatcttcccacttcagcctcccgagtagctgggaccacaggcatgcgccaccacgcccagctatttttttaaatttttggcagaggcaaggtctgtctatgtagccaagcctggtctcgaactcctaggctcaagtgatcctcccacctcagcctcccaaagtgctggaattacagatgcaagccactgcgcctggcttatatttttattattaaatgcaatagaaatatagataaatacgatgtgggctagggttagtgaattattagaaggcagacacaatgaaagaaatagaacttgaccagctctcgtgaaggcccttcatgtgtccatcccaatcaatttcagaacgtaaataggaagctggtagtattatggtaaatgcaaatccaactgcaaatgcatgtggacgtttcctggtgaagtgcatcagatattttggcaagtttttctaaaggccatgccctccgttctctctaaaggtgatttgaagctgacagctttcttgatacataacaatcctttctaaagttttacacgagcagacattttacatggttttcattttttccagccattattttcttagcttgaaggtgtctaagtagatgagaaacttcaaataccttatatttccacatgtttatcctaaaaaaattaatcaaagtcttattaataaaatgtattgttttagagaaatattcaactcacactgtcatactgagcattgaactggaataaacagagtggaaatagaaggacaattttctgggtactctgtgatttgggcagaatttcttcaacagaattagacttcacaagatgcatacatataacggaataaaaggttgcaagaatgctatagctatttacctttgtaaaaaatagttcgttctatttaattaacttatttatctatttaattttctttttaagagacagggtcttgctctgtcatccaggctggagtgcagtggcacaaccatagctcactgtagccttgaactcctgggctcaagcaatcctcctgcttcagccttctgagtagctggggctacaagtgtgatctagtttggatgtgtgttcctgcccaaatctcatgctgaactgtaattcccagtgttggaggtggagcctggtgggaggtgattggatcataggggtggtttctcatgaacgggttaccaccatccccttggtgctgtttgtgttatggtgagttctcacgagatctggttgtttgaaagtgtgtagcacctcccaccccgctcttgctcctgcttctgtcatttgagacgcctgcttcccctttccttccgccatgattgtaagtttcctgaggcctccccagaagcagaagccactatgctgcctgtacagcctgcagaaccgtaaaccaattaaacctcttttcttagaaattatccagtctcaggtatttctttatagcaatgtgagaatgggccaatacaaaacttgtgccaccatgcctggctatttttttaaaatttttttgtagagattaggtcttgccatgttaaccctgctggccttgaacttctggcttcgcacggttctcctgccttggcctcccagagtgctaggattacaggcatgaatcactatgcccagcatttgttctattttaaatgcagtatttgccatatacaaaatatgaagtatgtcaggcataataatataatgaactgtaaaatacctattgttcaacataataattacattagtaataatatcttgtatttatctgttttttccctgtttcatcccctattttgtttctacctggcattcaccactattctgaatttagattttatcatttccttgttttataaattgtgttactatatattctaataagtctaaactgtaagtgcgtgtgtattcatgtagatacatatatttgatcttaaattggacatacatctacactgttaataggtaatatagaatttgcttgatttgacacttaaaaaaatggtatcatagaactaccattccacccagcaatcccagtactgggtattttcccaaagggaaagaaatcatcatatcaaaaagacactgggcactcacatgtttattacagcatattcacaataggaaagatatagaatcaactttagtgtgcatcaatgcatgaatggataaagaaaatgtgatatatattttatatatatatatatgtacacacaatggaatactactcagtcaaaaaaaaagaagaaaataatttcttttacagcaacacagatggaactagacgccatctgtgtatcttgggtgaaacaacacagaaacagaaagccaaatactgcatgttttcacttataagtgggagccaaataatgtgtgcacatggacagagtgtggaataatagtcattggagacttggaagggtgggaggggagtgagggatgagaactcgcttaatgggtagaatgtaagtaattagggtgatggttacactaaaagccaatactttatcactatgcaatatgtccatgtaacaaaattttacttgtaccccttaaatttatacaaaaaaccatgctgggcttaatatctaggtgacgggttgataggtgcagcaaaccactatggcacccatttacctatgtaacaaacctgcacatccctgcacatgtaccccagaacttaaaataaaataaaatgaaataataaattatacaaaaaaccaaaacagaaaacaacaaaaatagtatcatacttcatagtagttttgtggacttcctttttcactcaattttcttttgcttacatttattcatatcgttgcatgtgtctgtatttcattctttttcttcttcttcttcttcttcttttttttttttttgggtacaaaatacccagttgagtgggtggaccacattatatttgtacattttcctgtcgatgggtatttggatcccttccaggattgactgtttaccaacagggacacaatgtagtacgtgtgtttggaggcgtgactgcaagtgtttacctacgatatccagtcaggagaggaagtgcggaagcataggcacgtggatttagctgacagatgatgcaaaaatcgttttcggctgggggcggtggttcacctgtaatcccagcactttgggaggcagaggcaggcggatgacttgaagtcaggagtcggagactagcctggccagcatggtcaaaccccgtctctactaaaaatacaaaaattagctgggtgtggtggcgcatgcttgtagtcccagctatttgggaggctgaggcaggagaatcgctcgaacccaggaggcagaggttgcagtgagctgagattgtgccactgcactccagcctgggggacagagtgagactctgtctcaaggaaaaaaaacatttccaaagaggtggtattaatttgcacaacagatagcgttatctaagcgttctctgttgatctagattctcttcaatgcttgacattttcagaatgttgaaactttcgctaattaaatggataagatatttatcacattgtggttttatcttccctgaattaacaaaatcaagcatcatttccaacgttttgaggtctcttgcgtgaaatgcctcctctttgactttctgagttttctaaggagttgtatcttttctatgtatctgaagctttgtatatgtccaggatataaatcgtttgatctcttcttttccaaagattttgcgcagtttttctcccatattggcatttccttttcattttatttatggagtctttagaaaaacaaaagttcttaagggtaagttgttagcatggcatttccttcaatggttaatatttttgtgtctttaaaaaagaatccttttggactccaagatgagagagatatttttcctatatttccttctagaggtttaactttaatccatctggaaatatgtgtatgtgtagtggagggagggttcatatggctttcattttttccatatggaaaaccaattgtcccagctctatttattgaatagttcctcatttgctcactgatctgtaatgtcacctccttcctgtattatattatagcacacgttgactctaatgcttccaacagggagtctctgtgctcctttgcttggagtctttatctgacccggggagcccgatagttggacatgtgtcagtcaagccatagtgctgagaatctaggagatcccacaaagaaccgccctcagctgaggactgatgaatgttgaagggcaagtactctcactcacctatcccacagctggaaagagtattctactctttccaaagcttgcagcactctgcatcctgatctcttcttatgagatgtcttagtccatttcaggctgttatcacagactaccatagactggatggcttgtaaacaacagacattgattctctcagggtcacggaagctagaagtctgagattaaggtgtgggcagggctgcttcctcctgaggcttccctgcttggcttgtagattgtaaacactgtcttctccctgtgtcctaatgtggttgttcctctgtgtgtgtgcagagggagaactctgaaatggtttcctcttcttataaagattaagacccctctcacgattttacctaaacccaatcatccccttaaaggctctgtcttcacataatctcacatgggggttttgggcttaaacccatgaatttggggcaaaagggcacagttcaattcatagtaattattcaaccaaagtagatgattggcttctggtgggaaagagggaataaaaatggagagagtattatattagagaaagagagatgagagcttcatgtaaaatttttgagaaataggggagcctgggaatggatgatttggagagtcgagatgatgcaatattatataatctttgtgctgagagtgcaggaccgtggctaggtggtttgaaatactcaagacgaagtttgaaattggagcttacttcagccggggtcttcaccctggttatccatggtggtcacctgcttggtaaacatcccattcaaggactttctccactctctagctcattattccactttctgttggtgcttcctggctcgccacccagataaactccttaatagaatctttgtatcaggattcagtaggttaggtgtattaaatgcattttagacttgcaattttgtttttttctttttttcttttttatttttttgagacagggtctcactctgttgcccaagctggaggacagtggtacaatcatagcttactgcagcctcaacctctggtactcaagtgatccttctgcctcagcctcccaagttggattacaggtgtgcaccaccatgcccagttaattgttttttcttttgtagagacagagtctcgatatgttgcacaggctggtctcaaacttctgggctcaagtgattctcccatttctgccttccgaagttctgggatttcaggtgtgagccactgtgtccagcctagacttacactattttcaacttataacaggtttattgggctgtagccctattgtgaaagtcgaggagcatgtgtactttgaacagccctggacacgagatacacattaaatgactgagaaactaaaaccctattttagatagcgtgtttctgttgctgtagaatgagtcacctcatctatcaagaccaagccatgaatgcacttgagttacattttttaatattttcatggactcctaaaaatctccagtgttcttagatctcaattccaagaagagccggcttgtagactcgcagctgagaggcaggctatggtgaactcagacctggagaagatggaaggagtccagggagaaatggaaaatgatgaaagctttggcaaaagggtggtaaattgttcaaagaatgtttaaagaaaaaaaaatgaacagcaacaacaactttagaaggaaatggaactgattaaaagagtcatttttattccacttctgcaccatggaatggagtcacgcataacttgcatataattgaacattaaaaaaaattctgtagctcaatcaacttctcttggcagtgagcccatagaaaactcagaagaatcttttcagaactatttatgagctgtgctacagttgatgaaggtctggttgaggatggtgacagaggagaggaacggtattggccacaggcttaaagaacagcatatccatccactaaggctgtcgtaacaaagtcccacagagctggtggctcaaacaacagacattgattctcccacagtccttgaagctggaagtccaagatcaaggtgtgggcaggggtggttcctcctgaggcctctcttctgggcttgtagatgccgtcttctccttgtgtcctcacagggtcatctctctgtgtgtgtctgtgtcctcatcttctcttcttatgagatatcttagttcatttcaggctgctacaagagactaccatagactgggtggcttataaacaacagacattgattctcccacaatccttgaagctgaacgtccaagatcaaagtgtgggcagggctggttcctcccgaggcctctccccttggcttggagaagctaccttctccctgtgtcctcacagggttgtccctctgtgtgtgtctgtgtcctcatctcctcttcttatgaggtgtcttagtccatttcaggctgctatcacagaataccatagactgggaggcttaaacaacagacatttactctcccacaatacaggaagctggacgtctgagatcaaggtgtgggcagggctggttcttcctgtggcctctctcgttggcttgtagatgtcaccttctctctgtgtcttcacatgtttgtccctctgtgtgtgtgcagggggagaactctgaaatcttttcctcttcttataaatttgccaggcgtatcagattaagacccctcccttatgattttacctaaacccaatcacctccctgaaggctctgtcttcacataatctcacgtgaggatttatggcttaaacccatgaatttggagcaaaagggcataattcagttcataataattattcaaccaaagtagctgattggcttctgatgggcaagagggaataaaatggagagattattatattagagaaagagatatgagagcttcatgtaaaatttttgagaaataggagagcctgggaatgcataatttggagagtcgagatgatgcaatatcataggttctttgtgttgagcgtgcaggacagtcgctaggtggtttgaaaactcaagaggaagtttgaaattggagcttactgtggaattcacaaagatggtagtcaaaaacatgggaaatattaatgatacagcagcatttttcccaggctgttctgcaagggactggttcttcaagatattaaaaagggctctagaaaaaaaaaggaaggcagggagcaaggaaggaaggaaataaggaaggaaggggaagggaagggagggaggtgaaggagaaaggcagaaagggagaaagaaaaaagagaaaacacaaaggaagaaagagaaagaaaggagggaaagaagaaaaaggaataaagagagggagaggaagaagaggaagaagaagaagacgaagaagaagaaaggaaggaaggaaagaaggaaaggagaaagagagataggggaaaggaataaaaaaaaggaagaagaaagaaagaaaaagaaagaagaaagaaaggaaagaagggagggaaaaagagagagggagaaagacagatagaggaaaggaagaaaaaagataggaaaaaggaagaggaaagaaagaaaaaagaagaaagaaaaagaaagaaggaaagaaaaaagaaaggaaggaaggaggaagggaggaaggaaaggaaggaaggaaggaaacaaggaaggcacaaaggaagggagagagggacaaagagagagagggagaaagagaggaaggggaaaggaagaaagaaagagaaaaaaggaagaggaaagaaaaaagagagagaaaaacaaaacagaaagagagagaaagaaaaagaaagaaagaaaaagaaagaaaggaaggaaggagaaagaaagaaaaagatattttgcgatcaaataagatcaggaaatgcatggtagctcctacatcaacttaaacacattagtaagctttgtgattatacatgggggaatgagaattgcacatactgtttctcctcttcttcactgcctcccctttttttttgcaggagcacctgatgtagttgaggcaggtgagaggcagctgccacctctgagggcagatgggggcaggagggggcagggaacggggattgaggaccggcaggcaggatgggaatgagaaaaaccagggagatgacacacctgtggggcagaacccagatcagttgggaactcgccgtggctctctccctgatcacaacgttgtcaccagaccttcgaagtccagccctggaagtgactcagggactccctcctgggatgattcccttttattcacctgggctgcagtgcaggaggctgactgggttcacccatctgccctggacaccctaggaaactcttagagtccaccattctggttcctgaccctatgttcactcatgcccatctcttggcgtctcccgggaagcttgggcaagccctgctctctgacgtctgagcccaaatctcaccctggaaccctgatctaccaaagctcccctactctatatgcccaggaaatccagggataccacagtgggaatagaagatgctcaaaatacgccacagtgcagaattccacctgctgcttgtcactttgcaaatccctgtgtgaacccaaccagatggctgatattaggttccaagtctgaagccgtatttacttgcagctactgagagcacatttgctatcagggtgtgttctcatttcctagagtgggcaacaaatgaccacaggctgggtaggttaacacaacgggaatgtactcacccagtcctagaggccaggagtctcacatcaaggtgtgcgcagggccaagctccctccagaggctctagtgggggatccttcctgcctctcccagctcctgggggctctaggcatccctgggcttgtggccgcatcactgcagtctctgcctccatctccatgtggccttctcctctgtttctgtgtctcctcttctgtctcttggaaggacacctgtcattgcatttagggcccatcctaatctaggatgatctcatctcaagatccgtctcctaattatatctgcaaaggctgtatttctaaatacaaggtcccatttacacgttcggaggcataggacatgaacacgtttggggtcgccattcaatccattacggttgtatccagttccctccagaggctctaggtgagggtccttcctccctctcccagctcctgggagctccaggcatccctgggcttgtggccacatcactccagtctctgcctccgtctcctcttctgtctcttaaaaggacacaggccattgggtttagggctcaccctactctaggacgatctcattttgagatccttaacttattacaaagaccctatttccaaataagatcccattcacagactctgggcattaggatgtggacagatctttccaggggccactatacagttgtacccagttccctctgaaagctctaggggaggctccttcctgcctctcccagctccgggggctccaggtgtccctgggcttgtggccacattgctctagtctctttctcactctccttgtggccttctcctctgagtgtctctgtgtctcttctctttatatggacactggtagatctggggtccacccagataatccactatgatttcatcccaaggtccttcgcttaatcacatctgcagataccttttttccaaataaggtgacattctgaggttctagggatttgacatagacatttctcttccgctattctatggtatggaaaagtggaaaaaagcaaatactaaaacttgttaataaggacctgtttcctctctgtgtagagcctcttctgaaactcctggtatgttcttgcatgaaaaatgcctagaccgcgatgaggactggtgtaaacggtagatatcatctctatagcaacacataaattagcattcagaaatgcagctttgcagagagaagaacctttctctgagttcctacactcaattctgtataagattcatttatttattattattttttctttttgagacagggtttagctctgccactcaggctagagtacagtggcacgatcagagctcactgcagcctcaaactcctgggctcaagtgatcctcccacctcagcgtcccaagtggctgggattacaggtgttctctgccatgtctggctacattttttatttttactagtgacgagatctcattatataatcccagcacttcgggaaactgaggcaggaggatctcttcagcccaggaattcaagaccagcgtggacaatgcagtgagacctcctctctactaaaaataatttaaaaaaattaggcaggcataatagtgcatgtccatagtcccagctactccagaggctgaaggagaatcagttgagcccaggagttccaggctgcagtgagctatgatcacaccactgcactccagcctggtgacagcaaactctgtctctaaaacaaaaaataaaataatacaattcaatgaaataaattaaaaaaacatgtggacttagagtctacttgtaatccccaccactggagaatcatttagtacagcaaagctgaaagaccaggaacggggactttccaacgtttctacaggacactctgaggcaggggggctgcgcttccttgaatgccatatctgtggataaaatcagcacattatcattagtacaggactggtctttttcttttctttacttttttttttttttctttgagactgagtcttgctctgttacccaggctggagtgcagtggctcactacaacctccaccgcctaggttcaagcgattctcctgccttagcctcctgagtagctgggattagaggcgcccaccactgtgcttggctaacttttgtatttttagtagagacagggtttcaccatgttggccaggctggtctcgaactcctaacctcaggtgatctgcctgccttggtcttctaaattactgggattacaggcgtgagccactgctcccagccagtacatgactattatttggaaaggtgcatggtagaagctgctcttggcagagaaacctgcgtaagaatcccccttgaagcttggagggatattactgggatcattgcttaagccatgggaaactggtttaaaaaatttgggagtggtttgcataatgtaaaacagggaagatgcactcagaggagaagttaaaacagccatggtaggtcagcctctgttgcagtcggggtagaaggagaacttggttgtcaaagtgtacgttgaattgagtttcggaagaacaggtcactgaaatttatcagcaaacttgatttaatggagattttcttgtgcattcgggaggtttttttccggtattccacgctgttaaaattaatgtttgagggcccagaatgagcacaagtgtttttgtaggcagaacctctgtggctccatgctgaagacatcagggtgtttacgttattatgtgggcaactaatgatggaaacagattttctactcctattttcttttactgattcatttgctaaagacatgtaatgtaagcagaattctccaaaggcatttaatcatagaagtgatggctaaaagaagccaacgattctgaaatgtcctaatgggatatttggccatttaggtgacttcactaccttcttgtgacagaatctttggacacagaacatcattctcacttcatattccatgagtacatcatcatctccacattatgctaaggcactcgttagtcacaaaatcaagaattcacttctgaaatattttaattccatgtagctctagtaaattttctttctttctttttccttttttttgagacagggtctcgccctgtcgcccaggctagagtgcagtggtgtgatctcagctcactgcagcctccgcctcccaggttcaagtgattctcgtgcctcagcctcctgagtagctagaattataggcacccgccaccacacctggctaatttttgtatttttagcagagacagcatttcatcatgttgcccaggctggcctcgacctcctgagctcaagcgatccgcccgccttggtctctgaaagttctgagattacaggtgtgagccaccttgcctggccctgaattttatttctaccatgctactccagaaatgtagacatgtcaaggatgtaaaatcatgaatagcatatgacctagcaatgaccttgtaaagtgattatatttatattacacataacatcctactaaacaattgtattacatttcaagatgtaaaaggaagaaaaataagccaatgttactcaaatatgttcaaagccacatggaaaagaaaatctgcgttatttcttctctggaagctcaaatgcctgttttctgccaaaagtgtaatttgaacagaaaaaaaaaaaaaagttggccaggcgcagtggctcacacctgtaatcccagcactctgggaggctgaggcaggtggatcacgaggtcaggagatcgagaccatcctggctaacacggtgaaaccccgtctctactgaaaatacaaaaaaaattagccgggcatggtggcaggcgcctgtagtcacagctacttgggaggctgaggcaggagaatggcgtgcacccaggagcggaggttgcagtgagcccagatcgcgccactgcactccagcccgggtgacagagcaagactctgtctcaaaaaaaaaaaaaaaaaaaaagttgagtgtgtttcagacagctgttgtcagactttggcaatggataagtggaaaaaactccacacaaggtcaagaacttcttaggatccttagtgagaaagtgattctgaaatcgtttgccatggacgttcaaagacccaccgacacacaagcaaatgaggtcgtgtttggaagagacacacacgcgttgatgtaaaaatagcagaacagtacaagagcagaatgcgatgacatttaacaaagtaagaattttttttttgtaaattctagaaagtgacactctaagtcagcgtgtttcttcaactggatgatcaagttcacagcccaagaatttgcccaacttccttagatgtcctcctctctaaacgatggtaaggatgatgttatgagattcctgaaagggaagccagattgcttatcaaagacgtgtgcccactgagcctttccaagtgctttactctgagatggtccaagaggtgtttctgagaaggctatttttattgtctttggtgacacattatgtgatgcagatgtggtttccatcaatccatctagaaagtctatgcatagggttatgtctcactttccctattagtgacctggaggaagcactgcatttttgtatgcaatgatacacccatgcatgccaacttccatttatcctctttgaagatgcatgacagtacttttccttggctcttcaaaactcccaaaggggaagcaggacatgcttcctggtggtttcacttgtgttgaatctagtctcaagcctctggcatcttctgcaccccaagcctctctggacctgtgtcctggagttgctgtaggggctggacccatcatcataatgaattacaatgtggggaactcaactggacccagaaaatgtccccaaagtgcatccttatggctgagtacctccagggttcacagaaggaatgaggacaagcaaactgtgaagcaagaccctgacacaaagacacagctcaaatttagcctctgatatggtttggctgtgtctttaccaaaatcccatcttgaattgtagctcccacaattcccatgtgttgtgggagggactcagtgggaggtaattgaatcatgggggcaggtctttcccgtgctagtctcatggtagtgaataaggctcagaagatctggtagttttataaaggtgagtttccctagacaagctctcttgtctgtcaccatgtgagccatggctttcaccttctgccatgatcgtgaggcctccccagccagatggaaccatgacttctttcttttgtaaattgcccagtctcaggtatgtctttatcagcagcgtgaaaatggactaatacagcctctctggtttaccagtgaacaccggatgggaccaggattcatgttagagaatgtcccctgtatttgaatccatgtggattctctcactcttctgacccagcttggtgttttaaatttctatccttaaagtccttttcttcccacaaatgtttgctgttgcaaagttcagtttactagtgtatggggaataaaacacatggtcatgatagcctaagctgtaccatgcaacagcaatggagacggctgtcctccctcccaacagcttaatgcaaagaaacttctgctgttgtagaactctctttttttttttttttgcctgatcctttgaagtcaagagttttattgttactattatgattcctcctccagtcatctgcaatcatagcttcaagaagaaaattcttagccaacctcagagtccctttatttgcatgttgcccatggtggcaacaggggatttttggtggtcagggtacatatctgcctcaaatcctagattcatgatcacagcaccccacaggatgacacacaggttttttgtttgtttgtttgtttgtttgttttgaaacaggatcttgctctgttgcccaggctggagtgcagtggcacgttcacggctcactacagcctcgacctcccaggctcaagtgattctcccaccttagccctctaagtagccggaactacaggtacctggcaccatgtccagctaatttttgtattcttagtagagactgccttttgccatgttgcccagactggtctcaaactcctgggctcaagtgatccaccagcctcagcctcccaaagtgctgggattctaggcatgagacactgtgccccgccagacccacaggtttgatttagtttttcaagagcagtttaagaagaagcaagactttttcattttaatgttttgctatttttagcctcaagaaggctgtgttccttgcagaagtggcatatcagctcaccctgggacaagtggcatctggtgagatgataggcagctgaggttattggtgttatttgcaagggatgggtgctgatgattgccattacatcgggtttccctgatgctcagttaactctaaaggagacatggggtgagggctatgagtagggatgtggggaaaccccatggctgggatgccaagagccccacctgggcttatgtccacttcagaatgcaccatctcatggaaagcaagacatcctccacctacacttagcattttcactaccacacactgagtttcccttatctgagatgcttgggaccagaagcagtgacagatttcagatttgttcagattctggaatatttgaatatgcatgagatgtcttgggaataagacataagtataagcataaaattaatttgtgttttatatacactttatacacatagtttattgtatagcctttcatatacaatactgttatttttgttgttatcatcattatacttttagagtcagggtctcactctgtcactggagctgcagtgcagtggtgcagtcacagctgactccagcctcagtctctcgggctcaagtgatcctcacaactcagcctccccagtagctgggactacaggcacgtgccaccatgcctggctattttttttctagaaatgggctcttgctgtgttgcccaggctgatctcgaactcctaagctaaggctgtcctccgccctcagcatcccaaagtgctaggattataggcattatccactgtgcccaacctatacaatattttaaaataattttgtgcatgagacaaagtttgtttacagcgaaccaacagaaagcaaaggttgaccaggtttggtggctcacacctgtaatcccagcacttcaggaggccaaggggggtggatcatttgagcccaggggttcaagaccagcctgggcaacatggcaaaaccttgtccctacaaaaaaatgcaaaaattagccgggtgtggtggcacacacctgtagtcccagctactcaggaggctgaggtgggaggatctcttgagcccaggaggtggagattgcagtgagccatggttgcaccactgcactccagccagggtgggcaatggagtgagaccctatctgaaaaaaagtaaaaaatagatagataaataaataaataagacaggaagcaaaggtgtcagttgtcagtctctcggtcatccatgcagaaaatctgacatcatgtgagcattccaaaagttaaagattttggaacattttggattttggattttcagatgaggaatgtccaccttgtactgagaaagccttcatttattggtaggagggaggaatctagggaaatctaaggaaagtactcatgtcagaagtgtttgaaccagggcgactctatcttgaataggggctgggtaaaatgaggccaagacctactggactgcattcccaggaggtgaggcattctaagtcacagaatgggataggaggctggcacaagatacaggtcttgctggtaaaacagcatgtggtaaagaagccagccaaaagccaccaaatccaagatggcaacaaaagcaacctctggtcattctcactaatcattatactctaattataatgcattagcatactaagagacactcccaccagcaccatgacagtttacagatgctatggcaacatctggaaattaccctatatggtctcaaagggagagaaaccctcagttccgggaattgtccactcctttcccagaaaaataatgaatatttcacctcttgtttagcatataatcaagaaataactataagtatcctttgtccggcagcccaagctgctgctgtacctatggaatagctattctttacttcttttctttttcttttcttttttttttttttttgagacaatcttgctctgttgcccaggctgcagtgcagtggcgcgatctcgactcactgcaacctccacctcccaagtttgagcaattcttctgcctcagcctcctgagtacctgggattacaggcatgaaccaccatgcccagctaatttttgtatttttagtagagacggggtttcaccatgttggccaggctggtctcgaactcctgacctctggtgatgtgcctgccttggcctcccaaagtgccgggattacaggcgtgagccaccgtgcctggccattcctttactttcttaataaacttgctttcactttgctctgtagattcaccctgaattctttcttgcacgaggtccaagaaccctctcttgggatctggatggggaccgctttgtggtaatactcagaacagaaaatgagtaattatggggatcttacttcttaaaccaaagcaagataaggtgtgtgtaatatcacactttcctcttaaactgtgtcccacatgtgtgacaatatctaaattcttaaaataaggccctaagggttctcctcaattacctaggagttccctggaaagcagataattatgaagtgctctaaccaaataactttatagagaaggaggtttgcttatcagccattctttcgtttttccttctggagtcctgtacttacatgtacacgcatacatcagccctatatcagctctggggaatgttgtgtttggaataagccagcgagtttgttgtgttcccataatttgtccggaggtgagcaggtgactcaatctaatctatgtttaaagattgaagagaggaaacctaggattggaggatggggaaacagggggagtaaggtgcaggagattgtcatggaaaccaacaagagtcctggcctcaatccacacctctggttactaatgtggatttgaatccacttccatccatgaatatgcaaatgaaaagtttctgagacaggtttcaagcaacttagaaagtttattttgccaaggttaagcatgcgcctatgacacagcctcaggagatcctgagaatgtgcgcccaaggtggtcgggctacagcttggttttacacattttagggagacatgagaaattaatcaatacatatcagatgtccattggttcggtccagaatggcaggacaacttgaagtggggacttccaggtcataggtagatttaaagattttccgattggcaattggttgaaagaattattatcaatagaaaggaatgtctgggttatggtcaggggctgtggagacctaggttttatgatgcagaggaagtctccaggtagcaggcttcagagaataaattgtaaatgttccttattagagtctgttctttcagtaattccaaaatgggggagggtatcatgagccatgcccaacttcaccttcatggcctgaacacatttttcagattacacctgaaaaatggaacgcccttgccaagaggaagagtccattcagatgatgggggcgtggggacttagaattttattttaaggcttgtagatacaaccattctatctatgcatacaaagaggtatctatcatacaagaagaactcccaatgggcagaacatcattgtgtacacatttgactctagaattcactcttctttttgtggctaaacgggcttctcatacaatccactaggctcagaaaggttcaccaaaaaatacaatgggttcttcgtaaaaggcaagagtcaaatgctaagttgatagctgtttttaatcatacaaagagctgtgtttaaattggataatgggtgtgtaataatacattctcttctttatgacttgacatcattatgaaatatgagctctggctaaagctcaggataatgtgggagagaattaagttgagaaaaccagtttctttcataatggacaactgagaaaagttttgggatttccattacagcagattttttgaagactcacttaatgttttctgcaggatggcttagcattcctaaattcagttgagtaccaggatattataaggcttttctgtttatttttgtaacaatctgttttcggagaaccttctctgacatagacattttgcttggggccaagaatacaatgatcacatggatgacacattcactctctttatgaagtttacagacacactgcaaataatgaagtagacgaagaattaatgtcagtaagaagactgactccagagaaaagtgctgattccttaactacctaggaagaagcaaatacagattccttttgtttgaagatgtgtttatatttggagatattcaggaaaacaggaagccctcaaaatagtacattgaaagtccactaacatggaaagtctccataagccagtcaatagcatttgtaatctgcattatataatgcactgttctgctttcttaactagactttttttttgctaagtaggtttgtgtattagtcagggttcaccagtgggacaaacctaataggatctatgtgtatatgaaagggagtttatgagggagcattggctcacatgatcacaaggtgaggttccacgataggccatctgcaagttgaggaagtaggaagccagtagtggctcagtccaaatcccaaagtctcaaaagtagggaagctgacagtgcagccttcagtctgtggccgaaggcctgagaccacctggcaagccactggtgtaagtccaagggtccaaaagctgaagaacctggggcctgatgtccaagggcatccagtacgggagaaagatgaagaccagaagcctcagcaagtctgctcttttcaacttctcctgcttgcttcattttagccgtgctggcagctgattggatggtgcccacccacactgagggtgggtcttcctctcctagtccaccgactcaatgtcagtctcctctggcaacaccctcacagacacacccagaaacaatactttaccagctatctaggcgtcctgcaatccaatcaagttgacacctaatattcaccatcacagttgataagcaacctagtttatgataatctgctatagctgcctgaaaaaaaaactaagtaggtcttagaccacgactttgccccatattatcaaaattaggacaaactttttttattatatgtctgggactgacaaaacaatcactcttagacaaaaattaaattgttagctatgatgaccagtgctgagaagatcacatgatggataccctaaaagccctgacttcaccactatgcaatctatgtctgtaacaaagttgcacttgtaccccataaatggacacaaataacataattgaatttgcttttcaatgatctttaagcatcattttcactcaagttagaaaatgttttgtgtcaagtagaaataactcacaaggatttagtaaaagcgtggtagatccaggctgacatctctgcccttggcaaatagcacccaaacatcttgtctttcctaatttagaggcctctcctgtaaccttgtcaatgagtgtagtccactatcaaagccaaagtgaaacaaaaccctttgctctctgcccatgggagctaaagtgtggaattgcaacgaggtccagagagaaatgcaagaaggtctgttagattcgtgaatcaatggatgcaagtaggtcactaatcaaagcctcagttgcaaaaacgactgcttgtctagcatgacttcagctgcaataacaaactgccaaagactgggtggcttataaaccacagaaattcatttttcatggttctggaggctagaagtccaagatcgagatgccagcggctctggtgtctggtgaagaaactctgtctggtttgtcgacagctatattctcattgtgtcctcgcatggcagagggtgggaggagagaaagggagggagggaggagagagagaggaagtgagagagagagaggaagagagagaaagagagagacagagagagagaggaagagagagaaggagagtgagaaagccccagaaagggggagacacaaacactcaatcaacatcacccacatttaaggtattggacatttgggtgctgatattttgagataattttacttctattcaaaattagatctgtcttctacacagaatccatgtattctttatttttatagattaagtcctggttcttctagagaaatgacagactcggagagcaggaaatgagtgtgtttacttaacaacacttaaaagtgatcccactcactgtgaaggtcaggcagagtacagtctttttgtaaattagtattattttgtatttttaatcacagatccaggttgtgcaacttttcaacccagcagtacttttacttggcattaggaaaaggccctttgaagtttgatgacgatgattttttttttttttttaaaaaggatgttgagaggttggatggactctcatgcaccacaaatgagctttttcttctttgcagaaaagcctgttgcttgaatgggtgtctttacctaaacttaaaagcaaatgctatcaacagtttagataaaacctttttaatcatagtccaagctgagctctgctttgctgtggatttgctgtccttgtgtgtgatttgccgcacttcacactgataaccttgaactatgttctcagtttattataacaaaaaacaatcaaattatgcaaaatcttattttgtaaaacgagtttgatgattgcttaaatcttagtcatgttttaatgttagtatactcttctctcagtgaagttatgcatttttaatatctaagaatagtattatatattattctacatgtttgctacccacacattgagtaacataaagatgacttcctaccgcccctgcattttcttctgtgcttacttttttttaaaaccgttaattagaatctatgttgctaaaaaacatgttgcaacacaaaaactggcctgtgttctcatttcagcacatgcattttaaaagagatgctttcttctccattggggaagaagatatggctgacactgactctatcttctctaacgcctttctttcaccccacttctcttatctcccttcttttaacttgaaagaacaggagttgagatttctctcaacacataacattccaaaggaaataaattcttaaatggaaacttaccaaacttctcattctctatttccttccaactttttcataaacacccagatgattttttttggtataaagtcatttttcatgggaaacctggaagagttgttgaaagaatatgcagtgctattttctctgtagctctgacttagtttctgcagtacattgaggttaaaaatgatagagttctaagggaggaagctgaggaagagaatgaactgaaacctaggaattacaaccattgtgtgaagtctgttttgagatgaacagaaactattaggttggtgcaaaagtcattgcggtttttggctggatgcagtggctcacgcctgtaatcccagcactttgggaggccgaggctggcagatcacttgaactcaggagttctaggccagcgtggccaacatggtgaatccccgtctctactaaaaatacaaaaactagccaggcatggtggctcacacgtgtaatctcagctactcaagtggttgaggcaggagaaccgcttgaacccagggggcagaggctgcagtgagccgagatcacaccactgcactccaacctgggtgacagagtgagaacgtgtctcaaaaaacaaacaaacaaaaacccttaatcctcagtgcaacagtgcgggggtggggcttttgggagatgtttaagtcatgagggcttcacctttatgagcagattaataaaataaatgagaggaagtgagtttggttcccctcttgctcttctccctttcaccatgggagaatgccacaagaaggcccttgcaagatgccaacatcctgatcttcgactttcctgcttctagaactgaaggaataaatttctgttctttataaattactcaagtcttgagtattctgctatagcagcacaaaacagacctaggccccatgccctccagtgtctccatccacaaagttatttgatggaatcttcatagatcagtcttcctaaattgctgttttgctcttgccagttctcatttccaaaatgttttagcaattccccgttgactaaaggatggaattgcagatgaaaattgagaactagaagacaccatagggctatactctctacccctgcacatagaaatgaagaaagtatcctgctagtgaaaattcctatttgttggctaatatgattatatcttgaaatttcttagtggtggtggatggtgcattactccatgtcacctggccccattgactttctgtgttcttccacattttactttttttccttttaaaagtcagggtctcactctgtcacccaggctaatgtgcagtggtgcaatcatagctcactggggcctggaactcctgggctcaagcaatcctcccacatcaggctcctgagtagctgggaccacaggctgacaccattgtcctcagctaaccttttctttaattctttgtagagatggagtttcactatcttgcccaggctggtctcaaactcctgggctcaagtgatcctcctgcctcggctccccaaagttctgggattacagacatgagccactgcacctggccttgtgttctctcacattttagcaactttggctgaaggtgtaacagcaataatgttcaaaaagtaacttttattaaaaataagcattaagcatcatagcatcaatgtattctcttttaataacattgactttctcccgttaattttccctttataaaacgtacgtaagggatataaacacatttgcaaaatcaaacctattttgtatttgtatcctaccaaacacaaaataataataatgataataataatagttataaataagaaataaataaaatatttctaaatattttatttagatttagatttatttatataattattctaaataattctacaataaaattattccatagcctcatatatttcaactcaaaagtgatcttggctggtgcagtggctcacgcctctaatgccaacactttgggagactgaggtgggagaatcgcttgagtgcaggagtttgtgaccagcctaggcaacataacgagatctcatgtctacaaaaaaaggttatctcacatgccacatgcccttcagaaactgatagactatattgataatcacctctaaattaacaacataaagaaggtgaatagtacaagttttccccaattcaatcaaataataatccaaaatctgaaattctgaaagaacaaagtagtcttgggcaccaagccatgatttacaaaatactcttagatggcttgaaaaatctatggctcttcttataatactagatttcttagataggtccagtagactggtagacttttttatggttttatgcattttctctttttaaaatttttatatttaatttgagatctggggtacatgtggaggatgtacgggtttgttacataggtaaacgtgtcccatggtagtttgccacacctatcaacccatcacctaggtattgagcccggcatgcattaactatttttcttggtgctctccctccccctgctcccctgataggctccagtgtgtgttgttcccctccctgtgtccatgtgttctcattgtttctctcccacttttaagtgagaacatgctgtgtttgattttctgttcctgcattcgtttgctgaggataatggcttccagctccatccatgtccctgcaaaggacatgatctcattccttttcagggctgcatagtattccatggtttatatgtaccatgttttctttatccagtctaccattgatgggcatttggattgattctatgtctttgctattgtgaatagtgttgcaatgaacatatgcacacatgtatctttgtaatagaatgatttatacttcttttggtatatacccagtaatgagattactggatcaaatggtatttctggttccagatctttgaggaatcgccaccctgtttgtgtgcattttttactgttgcataacaaattacaaacttggtggcttgaaactatccccatttatcatcttggagtgatataggtcagatatctggacatgttctggctgggttctctactcagggtctccccaggctgaaatcaaggtgttatcagggttgcagtgtcatctgaagctgggtgccttcttctcagctccctggttgttggcagaattgagttcctagaggctgaaggagtgtgtctctaacttgtttctagctgttagccaaagccatactcagcttctacaggtagctggccctatggccctttccacaacatggcagtttttttgtctgcaaggtcatcaggggaatttcactgctactttggatgtctgacttccctgtgtctgactctaggcccagttttagatggctcatgtgattaggtcaagcttccctttcttagggtccacctatttgggacattaatgatgtctgcaaaatcccatcacagcaacacccagatatgtgtttgactgaacaatgtgcgtgcttaccagggcccaaagtcttggcagccatcttggaattctgcttcctacaattgcctattcacacaacgaaatattacacagcagtcaggaagaatggatgagagccatcagcaggctggagacccagggaagggctgatgttgcagcttgagtttgaaggcattggaggcaacagtctctcttctgcagggacctcactcttttctcctaaagctgattggatgacgccagtccctacatgaaggtctagctatggattcaggagctttgaagggctcagaaccactttctctgttggagaccatgtagaggttggacacaataatttaaacatccacagtcatctatcattttgtatcataaatacctggtctaagtacagcatttatcgagctcgtaactggtgactgtctagcccatcagttggtgtgaccacagaaaggtgctagaatctaggagtggtgacctagaaggacaatggcaaacatcacctttcttcttgggtaatttgcaacagaaactgtttattcactgctctacctccctccctaccgcttatggactgacttgtgtccctgctaaatttataagttgaagcctaaaccccaggacctcatttaaatataggtttcaagtatgactaaaatgactgcatttgaacattgggtctttcaagaggtacttaaggtaaaatgaggtcactagagtgggccctgatccaatagaactggtgtcttataagaagaggaaatgaagacacagacacacacagagggctgatcacatgaggacacagggaaaagatgagtccacaagccaaggtaagaggtttcaagagcaaccagctctgcctacaccttgatctcagatttccagcttttagaaccataaaaagacagatttctgagttttaagccaccaagtctgtgaaactttgagacaactttagcagacgaatgtactaccctcaccagcaaaagacaagtctaagttcttggccaagtatggtgttgtggttgagtcctctgggactcatgagatggtgtagcctcataagtgggactagtgtctgtataaaagggaccccagagagctccctcaccctttccaccatgtgaggtcacagcgagaagacgccgtctatgaaccaggaagtgggtccccaccagacactgaatctgccacgccttgatcttggacttcccagcttctataactgtaagcaataagtttctgtttataagcaactcagtttatgataatctgctgtagtagctgaaaaaactaagaagcaggtcttaaaccatgactgccttatattatcaaaatttgaacaaatatttcttattatatgcctgggactgacaaaacaatctccattaaacaaaaattaaattgttagctataagaccagcgctgaggacggtgagggagtgggaagacaggatgcatgggaaacaacttaatgggtgccatgtacatcactcacatgatggatgccctaaaagccctgacttcaccactatgcaatctacgcctgtaacaaaattacacttgtaccccataaatggacacaaataacataattgaatttgcttttaaatgctctttaagcatcatttttaatattgtcttcactcaagttagaaaatgtttggtgtcaagttgaaataactcacaaggatgtggtaaaagcgtggtagatccaggctggtatctctgctctgtattttgttaactatctgtctttatgaaagccatttctattggcatcaatttttttcagctgcaacatgaaggcatgcattaaataatttttgagatgcattgcaactataaatcattgataatttttgtaacaagaagattcacagctgcgacatgaaggcatgcgtttagtaacttttaagatgcattgcaactatgaatcatcgataatttccaagattcacttggaattccatttcttgcatgaacttgcatttaattccatatgttagagggagttggagggggaaaatgagattttattccagggaaggatataaagggtgttaaacattttttgctatgtaaatatacaggtcagctttgcagaaattttaaacattttgcaatgggaagcacagggtccttggcatctcaagaaaacatctgtaaacctcaataatatgggaagaatcacagggttttcaggtttgtagttttaggaggcttagaagattatgatgagaatttctttaggctccagaaaaaattgtctctcttttttcacagctgctttttggtgtttcttgaggctttattttaacaaccatgtgcacatgtgattttattataagccacatcaaatcctttgattctatgtggaggcatatggagtgtaaattatgtataaatgagcagtgagcatacatttggctatcctaggcagttttgtggtttgtggcagaaaattgctgtgtgtgagagcacctaggaggagagatgtggcgtttgatgtccagagacagataggactcagtaactactatggacagatgagaaggaaggctcattatgttttctctttgaaacagctttcttgggatataatttgcataccacacaattcacccatttatttcttatttttattttttatagatagggtcttactctgtcacccaggctggagggcagtggcgcgattatggatcactgcagcctcagcatcctgggcttaagtgatcctcccacctcagcctctcaagaaactgggactaccagcatgtgccagcatgcttgcctgattttgttgttgttggggtcttgctatgttgccccagctggccttaaactcctggactcaggtgatcctcccacctcagcctcccaaagtactgggattacaggtgtgagctaccacatccagcccagttctcccattttaagtataacacgcaatcatttttaggacattcatagttgtgcaacaatcaccacaatcaactttagaacattctcatcaattcaacaagaaattccacactttttagctatccttgcattattcctccaattacccctgatcccacatcccttggcaaccagtaatctgctttctgtctatggatttgcttattctgaacatttcctataaatggaatcataccatatgtggtccttggtgacgagtttctttcactgagcttaatgttttcaaggttcttccacattgtagcgtgtgtcaaagcttctttcttttttaaggctgattaatattctattgtgtatggctagaacacattttcatgataacattcaaagagtcagaaacaagtctacaggctttccaggccaaattctaggtgtggtttctctcggcaaagcattctccctgaacccccagagctgattgctgtatcgggccctgtcctggtaaggacagagagtgacattaactcatctctctttcttgggcctcacagtcgtctgtgtgatcgctgccagcacaatgtggaagggaagtcttggtttggctaactgcaacgtactcatggctcagattctgaccaaaagagttatttcattaaagacagacagggcaggtagaaaagcaaagcgcttgtaaacaaaccatgatgggcttctcccttccccctctttgcttccttccttccttcctttccttcctttctttcctttcctccctccctttctccttccttctttccttccttcgttcctttccttcctttcctcccttccttctttccttctttccttccttccttccttccttccttccttccttccttccttcccttcccttccttccctccctctcactctccttcctccttccttccttttctttccttctttctctttctttctttctttctttctttcttttctttctttctttctttctttctttctttctttctttctttctttctctctctttctttctttccttccttcctctttctttctttctccctcctttcttctttctttctccctcctttcttctttctttctttttttctttctttctgtcttagagacggtttcactctgttctcacccaggctggagtacagtggtgtgatcatagctcactgcagactcaaactcatgggctcaagtgtccttccacctcatcctcccaagtaactggggctacaagtgtgtgctatcatgcctggctaatatttttatttttatttttgtagagacagggtttcaatatattgctcaggctggtctcgaactcctgggctccagtgatcctcccaccttggccttccaaaatgctgggattatagctgagaaccaccttgcctagacccctgtctttctgaaggactgaacacactacttgggtcagccaaggcagagagatgtcttaaggccagtaaaacaagcaacgaagtgagccctcagaggagggggctatttcacaagaccactctcacttcggacaccagttgcaggttgagaagagttcccaaaactaccctcaagtttagtagttccctagaaggactcacagaactcactggaagatgttacactcacatttgtggtttattacagtgagaggatgacagatcacagtcagccaatggaagaggtgcatgggatagaggtccaagccaagtaccaaacagagcttctattatcctctccccttggagtcagggaagtgttggtttctaggcatcagtgtatggcaatatgcatgaagtgttgccaacttgggtgtagtagtccattcctgccttgttataaagaataaatggagtctgggtaatttataaagaaaagaggtttaattggctcacagttctgcaggctgtacaggaagcatgatgctggcatctgcttctcaggaggcctcaggaggctttcagtcacggcatagggtgaagggagagtaggtgtctcacgtggtggaagcaggaatgagagagtgaggaggggctacacacttttaaatgaccagatctcatgagggcacactcactatcacaaggacagtacgaaggggaatggtgctaaactattcatgaaaaatccacccacaggatccaatcacctcccaccaggccccactgccaaccttgggaatcacatttcagcatgagatttgaagcatatccaaaccatatcactgggcatatcacctgagccttggggttcagtgtttactgaggcttcattgtgattgattaattgtctatgtggctgatcattctccagtctcactggaagtctaccaataccatggaacctgaatcccattgttactaatggatgtggctaccctgactccaaatcacactgttagactgcccagtgtgaaccaacacccctacagaaacaaatacactcctgtctttgtttggcacacattccaaaggcttagatgtcaagttttagagtcaacgccaaacccagacctctccttgagcaaagttaaattctagccaactccaaagcccagacctctccttgagcaacgttaaactctttacctccaggtctgcagaactgaacagatgtccacatcctaatcccccatgtgggagacagaataatgcccccaaagatgcccacattctaatccccatgtggtggaaaaaataatgtccccaaagatgtctgcatcctaatccccatgtaatagaatactggccccagagatgtccacatcctaatccccatgtggtagacagaataatggccccaaaggtgtccatgtccaatgaatatgttgatttacatggtaaagcagactttgcagatgagatcaagttaaaaatcttgagatggggagattattctggattatttgggtggattcaatgtagtctcagtggttcttatagaaggaaggcagggattcagaaaaagagaaagaggagatgtgacaaagagagtggaggttggcgtgatgcaggaagaaagaaggcaccacaagccaaggaatacagcaacctctagaagctggaaaaagcaaggaaacagattcatccatggagcatccagaagaaccattcttgcagacacccttatttcagcccagtgaggctcagttaaatttctgttttggccactgaaatgaagccccttcctttataaggcaaaatacctagaccagcagccagaggagtcatggtttaaggtcctcagtggcctgcgagtgtcaatgttgctacctttggctgtacctacagccagcagctgcaacccccactcatggcataagatgccaaaaactgcaaggtcacaggaacatgcagccagcactttacgcagcctccatggggctacacaagaaaccctgatattgcaaaacagctcagagttcattgtttctcagcatccttctcagggtctcctagatgatgactttgggcatttaaggagcaatttatgtgtgcccctccccacttggttaggagcccactgcaaagtctacagggggtttggggagaaataaggacttctgtctatcactgctccagttacaatggaaagagagcctgtcacatgacccaagcaggctccccctcctcctgcacatgagcctatgctactggatggaaggaaaagaagctcaaagctgccttctcttaatatccttctctgactcaatgattcctacctggaggtggaagatgctgagaggacacacacgtttttatggagggagagaaggagagagaagaatggaggaagagagagggagagaaggaaaggaaggaagagagagaagaaagaagaaagagagagggatgaaggaagagagaggaagaaagggagagaaagaaggaaggaaggagggagggagggagggaaggaaggaaggaaggaaagagagagaaagaaagagagagaaagggaaggaagggaaggggaggagaggagaggagaggaaagaaaagaggaaaggaaaggaaaaaaatgaaaagagggaggcagagtgagacagagagtcagagagagaaagaggaagaaagagagaggaaaggagagaataagaagggggaaatggagaaatataaaaaggaccaaaaaaagaagagaggggggagggaaggagagagaaagaaggaggaggaggagagagaaagaaagaaaaacaggaagcagaggggagaaagagaaggaagtaagagaaagagagggaaagagggtgagagagatagaggaacgaatggtaaatagagagaagggagaaatggagaaagggagaagagattaagagaaagagaaggagagcagacagagagagagatgagatagtcagagagatatgaatggaggaaggaaaggagaaagagagagagaaaagaaggagaaggaggaggaggaagaggaggaggaggaaagagaaagagaaagaaaagagggggagggagaaagagaaagaaggaaagagagccagacagaaaggaacaaatggataaacagaggaaggaagggatggagaaagagaggagaaaaggagagagagggaaggaaggagggagtcagggagaaagagagacactgtgtgcttgaagaaaagttacaggactggctatcatttcctccggaggccaacaaaactctccctgctcgctaagccccactgaatatatttgaaagagctagtaagagataaaataaaattgctttgtgattatactcaatgagtcatgcttgttcgacacaccagttacatatgctttccccctaagagccctcaagaaataccagtcctatagtgtaatagagttggatctccaagagctgtttaggagcaagaactcagccgacaggatttctggagaatttctcctggcttgtctctgatcaagcaacgtcaccaagaggcgattattaaccccattgatgttggattcctcacttagagaaatgacggaatgactccttgttcatcctcagagctccttttattttcaaagttctatctcctaggtaaagattaaatttctgtattttatactaaacaactccaggctctaaccgtgttcgtctgcccatgtgttcaagatgggcacgcacatcagaatatcttgaacttgctggaagaagttaaggagcattcatggtctccatcttaggtgttttggagggtctgtagaaggttggggctattgctgctacagagaccatgactgacttcatgaggcttgttctgattgttcacaacaatggggtttggacaagaagatgaaggtgatgtgacagggttagatcctggagaaactcaactcactttggacagataatgggtgtaatgtcccctgattgtctggacttgacagcagagggcagcccacacttggactggcattattcagcacatgtgccattacatgtcattaaccttaacatgaaactttcacctctcagcccagatgtcttacccaaaactttctgggtttgtgggttgatgggatatctcttggttgactggattgttggcttggtggctgggttttgcatctctgacactgtcttcatcttttgtcctcctggcttgaattttgggatgaggtattctgcagtaggcaggcctatgcaaacctttccccaaaagtccaagaaagctgagaagtcaaagagagaggctgacacatctagtttctcagaaaaaacaaacaaacaaaaaaaaccccaaaacatttcataggtacttaaaaacagaagccatgtttgtgtcttggatggcagagagagaagatggtggatctccacaccactacccccaaataacccaggacttatataccatggagtaaggggtgtgtaggatgattgtttaagggcaggatttatggcaagaacatgctcttacacaaggaacagtagatagaatagaaatcttagaggcatgcctggaactagggtcaatcagaagtcaacatggtggattagcattcaagatggagctactttagcctccacatgaagatactttgatgatgaatgatgcacctgttctaaaacatgggtgggctgacacctcagcactggccctggttttgtctccaggactctcagcaactgcagacctcacaactataggaacaagcttcctactcaggtcctctggctctccagagcctctctgtttctgaactgtactgacaatccctgattctttacatgagttcctcaccacttgcctcatcccagccgtgagacttctggataggcacaaccacgtgattatattatcaaaggcttgccttccaactgaaataaccttataggaaattgttttgacatttcaataaaataaaccctcttgaagagaagccaacacaaataacctttgtaataaattctgctgtgctatagtaagatagtcacaggagttcacttccattcattgaaagtttaggggaaaaaagggggaaatcttacaagaatataagctcattcagttcatgcgttcctagaaggagaggttgagtttgcatagcttggctctttctcaagtccaagtctagtcaagaggcagtctttataaacaatgatagacaacttttctggggaaagatttgtttggaaagaaatggaggataattcaaaagaggtgattgaagccttagtacagtgggctttaaatgatgggttgtgtagtgtttatttcttcctgttggtggaggagagtgattaagggcttttcctaccttaaggtgatcaaagtggtattttcataagattaatctggcggcagaatgcagatagttctcagcctccccacccatccttggcgtatatagagcacctgggggcacatatgtccaagacagagacgtatacaggcaaagtaatgctttaatcttatgtctcagactaaacataactcagaggaagacaatgttgggaagagcaccaagaacttaagacatttgtgcacattccacattagccatcttttacatcacccctcggagcacgagagctctttcacttacttttggccaaattggatacagtttgccttcgtaatatgagggctatatagaggcatttcccaaaataaaagagtttatacgtttgacccatcccagattttgttcaatgctctagttcatgctttggtggtttcctcagacacagctgaatttataaacattctgagatgtcccatagatagaggattcaacctcagttcttccacctagcacacttgcttataaaatgacatgtaacctatgagttggctgaagccatgctgaaagccaatttttaggttccaaagcagagaatcttacaaggatgtgctcattttcactttgagacactgaaagagttggtgtctaggtggtctgggataataacctaagcacataatagctctaagcacgttgtcattaatccttttattggccatagacctccatgtggctagccaactgtaaagaacaccacccacctcagtggaaagcaggtgaaggggagaaatgcctcaacccactcaacattagtaatagtcagaatggaactgatagaataaaccctgggctcaccccttagaggaaaacttaagagcttatcttccttttatatttttcattctgtaatgagattgctttttgctagtctaccaatatatatgctattcatttttaatgcaagaaaaaaatatgcatacctaatacaaacacacacacatgtatgtgtatatgtgtgtgtatgtgtgcatgtattaggtaagtatgtgtgtatgcatgtgtattttttcttgcattaaaaaaaagataacagaatctttgaccacaagattttgggtaaaataccactttagtttatggaatagcaacctagtaaaagagcatgaatgttgaaagttataaagtcagaattctttgaggatcaaagactttttcagcccatcaaacatccaagagtaattcaatgtgaaaataggatttcttccccttgtgggggattcctcaatcgctgtttcttcatttaagcgacatttggacaggaataaaatgagaaagtacatgattcttccaaagtccctgaattttcaatgcgaccatattggagatgttcttttttgaacaatgttcccacaactagtaaagctttgtctaattcaagtccataagatagagactatgatacagacatttgataaatatacacctgagttggtaggttgcagaaggagctgctttgtgctttgaataactcaatttggtgatccacagtggattgggtggcttattcccagatcctcaccatcctttgtggtcagtagatatgtccaaccagttgatatggaaatggtcgtgtagatttaactgtaggaccaaggcacatgcagtggacttcttttgtcctggaagaaattagatcaatttcagcattgacaataacatctgagcttgggttgcttggctttcctggaagcatgttctttggtgtgcaaaaagagggtagatatatataattagtttgaaatttttaagggactttgatcaacccgtataagggactttgatcaacccgtatagctgcataacgtgtgtgggctttgtgaaatgtgctgagcgctaatttttaattctttcagcaacacacattcaaatgcaaacctgaatgtgtttgttgtcatgcaaaattaaaataagaaatgtagaaaattctttaaaatgaaaatgatagggactcaccttattttgttttttgtttgtgtgtttattttttgagaaagaatctcgctctgttcccctgggctggagcacagtggtgcaatctcagctcactgcagcctctgtcttccaggttcaagcgattctcctgcctcagcctcccgagtagctgagattacaggcataggccaccacactcagctaatttttgtatttttttgtagaaacagggtttcactatgttggccaacctggtctcgaactcctgaccttaagtgactctcccgcctcggcctcccaaagctctgggattacaagcgtgagtcagcgtgcccggcctttattttgtttctaagatgggaaatgaacctaagactcttgaagacatttacaacgtcaattttatcaaaacaattgagagaattcaggtcataattttgagaaacaataaaaatggtcagacaaatgctgtctatgacgagtgaaagagctctatgagttttagaacaatggtctccaaggtagggagattttgttctatgccaggggacacttggcaatgtctgtagatattcttcagtgtcacaactgagtggtctcactggcacctggtgcgtggagcccaaggatgttgctcgacaccctacagtgcacaggacacccccaccacagagaatcatccactccgaaatgtcagcagtgccagctcaactgcaaaaccctgccttagcatgagagactctgtgtgcctgtctgtcatctatttatctatctctctttttgtccacctatctgttatctgtctatcatctatatatctatccacctatcatctatttggtcatctatctgttatcattattatctatctatatatctgttgattatctatctatttatctatcaatccatctgtattagtccgttttcacactgctgataaaaacatacccaagactgggtaaattataaagaaaaagaagtttaatgaactcacagttccacgtggttggggagacctcacaatcatggaggaaggcgaaaggcatgtcttacatggcagcaggcaagagaaaggatgagaaccaagagaaaggggtttctttttattattaaaacatcagatgtcctgagacttattcactatcaggagaacaatatggggtaaactgccccccaagattcagttatctcccaccaggtccctcccacaacaggtgggaattatgggtgctaaaattcaagatgagatttgggtggggacacagccaaaccttatcaccatctatctatcgatctatctgtctatctatctattatctatctatctatctatctatcatcacaatggtttccaactgcagtccactttgccctcaggggacactggcaatgcctggagacattttctccaggtggagggttggtcctggcatctggtgggtggagcccagggacactgctcaacaccgtagagcacacaaggatgccccaccagagaatcatgcagccccaaatgtcaacagtgccaaagttgacactgctgctctgatggcactgttactctgttatagaagccatgtaggtctaaaaagatacaatgtagagagtagtggggattccagatgtgcaaatagagtaacaagtctctctggttttattttgtgtttgttttgttttgctcctgcttgggaggagggagtggaagaggggagagaagccaaataattggatgctggggatatccctaaatggtgggaccaatgacaaatcatcagtagtggcgacactaaaaagaacttaccggaaaagaatcttttatatccaatttttagccatctgtgtagattggctcttcgtgtctccctcatcctctaaaccttctcagcaaagcctgatgcatacaaagaagtcttgtgtgaattattttgtttgattattcctttacttagtcctttattcatctctggaggaaataaaagagtcgggattctgtgactgattcagcaaggggcaaaagagagacagtgtgtggatgttggacatatgatcgacagaatgaactaatgaactcaagacacgtccccttacccccatccatactttttatttactggaatcctgagaaaagcatccactgtttgtcagtcacagaattgggctttgaatggaatttatccaggacttaatatgaacacacctggaatgttcattagagcatctcttctccaaatatgacatcatgggagtgaatgaagcaaatcattttcttggctacttggcttgtaggtcatcttgtctcatacctggagaaaaatgtcagcttcactctatggtgaagtcttaggataacatctcttatgtagaagatgtgagtttgccttccagctaaaataaccttataggaaattgttttgatatttcaataaataagctctttgaataagagccaatacaaataacttttatattaaattctgctggtctatggtagaagtttaatcataggaggttacttccatacactgaatagtcagaaaaaacatcaaaaattctataagaacataataaagctcattcagctcattcatatctagaaggagagcttgaattcatgtaagttggccttttcccaggtcctaggctagtcctcaaatccagcctgcattttctttacgcccactgctactagaaaaaacatctggcagatttggaatatgaataacatcagagataaccagagaaaatctgctggccataacgagttgaggacaagctataaattgtaagtttgtgtcaattttcatttcctaaaggcagcttttataaaaggcattatttcatcccattaagagcttgggctgacatatgaatgcatcccataaattctttaccataatttgaccccattttgattatttatagccacaaacatttcttgagcagaatttcagaactttatttggaaagacaaattctgatataaattgaaattcactgaaacattcatatatatacacatacatacatacatacatacacatatatatactgtttaatatggatactctttttatatatgctgttttacctatatatataatcctacagttccatgttgtgtgtgtgtgtgtggagagagagagcatggcgcatgtatatgtgtgtgtatatatgtgtgtataaatagtacatataagtgtgtttatattgtacatatatgtttgtgtacatgtgtgtacatatagtgcatatacatatatgtatatatgatacatatgtgtatatgtgtgtcatatatagtatgtacatctatatatgtgtgttatatggtacaaatatacttgtatgtgtatgtgtgtgtgcatatatagtgcatatgtatgtgtatatgtatatataaagtaatatatgtgtgcatatatagtgcatatgtatgtgtgtatgtatatataaagtaatatatatgggtgtatgtgtgtgtgcatatgtacacagcatatgtgcatatatacacacacatagacatatgcaaacacacacatacgcccatgtatattactttatatatatacacatacatatgcatatatacacagtataactatatatatgtcatatataacagtatatacatgtctgtatatgtgtatatagcatatgtatgtatatattagtacatgtgtgtatataaagtacatatatggtacataagtgtgtgtgcttatatagactacattatatgtgtatatatgggtatgtataaagtacttgtgtatatatgtgtttatatataaagtacatatgtgtgtatagcacatatatgtatatatgcacatatagtacacatgtgtatatatcagtacatatgtgtgtatacatacaatacatatatgtgtgcatatgtatatgtgtatgtataaagtacttatatatgtgtatatgtgtgtgtatatattgtacctatgtgtgtgtatatgcctgtgtgtatacatggtacatatatgtgtatatattgatatatgtatatgtgtggggtgcatataaacaaaatatcaacagtatggaatattacggggtaatagacctgggttttggtcccatctttgattttgaggcaaattttcgtatagtccatgactaataataaaatacgcatgaaatgaaataattattttaatccagggagcaacacagtgttcagctcatcacaaacccacacattttcagagtttaggttttatcgaaggctaaagttgggatctgttcactagtgttttatctgcttccacaatgtctgatccaaacttcacatgctttcagtgactcaagacaagtaaagggacataggcctgtcggatttctgagagccgagcagcccctcagaggcacccactggaagactggatggcctgtgtctcctcagggcctgactcagcagggctgaagacacttcccctctctgatgtgtgataaatttagctaagaggttgcttcatttttgctgttcatggaagtgaaatcatgcttatttttggttccagtttcaatgaaatgtcattttcaatcaagtttctaattgaattttgtcttgtttttttgctcccccgagaaaaagaccatgaaagccagaatatatgtatgtgaaaatacatatattcaaacctaacctcaaaaaatatagtaagagctgaggtcacaaagaagagaaaaaaagtgtttctatttttcagtatttcagaatctagttggaaaaagtggtgtttatacaaccaataaggaatcaaagtctataaggtcagtaagaggggtcatgaacagacaccatgggagtggagaggagcgagagatgaattctgatttagggaaattaagagacattttaggaggagcttgtcctaattaaggctctaaagtcagataaaaaatttacataataaaaaataaaccagagactcctcaaactggaggtggcggaaacaaagagcagcacagaaaagcgagtccccgcactaagacagaagagtgaagactgggtggccagcatggtggagctgaggtgggtagggggacgatcaaattgatgagatgaatgtcgggtcagagcagctttgtgggacatcaagggaaggctcagagttagggtgtgtttctatgtgggaaggtgttgactgggtgtgctgagatgggagtttcaggtcatctccatgttgtggatgatgtaacagatgtagaggatagagacagagaaagacagagagagagaaagaaagagagaaagagaaagagagacagagagaaagatagagacgatagagacagagacagagagaaagatagagagacacagaaagacagaaagagagagagaaagactgaggacaaaagaaagactgagaaagagagaaagaaaaagagggagagcaagagaaagaaagaaagagagaagtcagaaggcatatgtgtgtgagaaagagagagacagagtcagtgccagagaaggaatgaggaaaacaaatagaaagggagaaagaaagaaaaacagaaagaaacagtgagagagagagggaaagaaaaaagagagaaaaagacagaaacagtgagtgtgtatgtgagacagagagagagagagagagagagagagagagagagaaacagagacagatggagttatagggcactggggcactagctgtctggaagctattacaagctatttattatttctttatttttccagaatgaccagcatgttattgatgagattgacattatgtaagggaattctctgtctgttcattctttttattttttttgagacagagtctcggtctgttgcccaggctggagtgcagtggtgtgatctctgttcactgcaacctctgcctcctgggttcatgccattctcctgcctcagcctcccgagtagctgggattacaggcacctgccatcacacctggctaatttttgtatttttagtagagatggggtttcaccatgttggccaggctggtctcaaactcctggccttaggcaatctgcccacctcggcctcccagagtgctgggattacaggtgtgagccaccgcactgtctgttcactcctatgtcttttactatctccttctaaaatgcaagtgtctgcaatttcctcacctttttttacacacgtaaacatcaaatttactattggaaccattttaaaatggcattaagtccatccagaaatttgtccaagcatcagcactctctagttcccgactttttcatcatctcaaatacacagctgctgtatttacaatagccagaaagtgaaaaccatccagatgtctatcagcagaggagtgaattaagaaaagatggtccatctatagaatgaaatcttattcagcctatattaggccgttctcccactgctataaagaaatatctgagactgggtaatttataaagaaaagaggttgaattggctcacggttctgcaggctgcacaggaagcatgatggcttctgcttggcttctggggaggccccaggaaaatttcaatcgtcgtaaaaggtgaaggggaagcaggaactcttgaacgtcttacacggctggggcaggagcaagagagagagcagggtagtgccacacacttttaaacaaccagatcttgtgagaactcattcactacacagtaccgagggggatagtgttagaccattcatgaaagattcactcccatgatccagccatctcccattgaggattgcaattcaacatgagatttgggtgggaacacagatccaaagcatatcacagccataaaaagaaatgcagttctcacatggctacaataaagatgagtcttgcaaatatcctgctcagtaaaagaaccgcatctcctatgacttcacttatattaaatgtcctccattattttctatgactaggctatacattgattggagcttttatacatattgatctatacgttgatagttgcggagataattgaacaaagatgcaaaaaactgtccaggtgcggtggctcacacctgtaatcccagcactttgggaggctgatgggggaagatcacttgaggtcaggagttcgagaccaacctggacaatatggtgaagccccatctctactaaaaatacaaaaattagccaggcatggtggtgcacgcctgtattcccagctacccaggagggtgaggcaggagaatcgtttgaacccgggaggtgaaatcgcaccactgcactccagcctgggtgacagagcaagactgtctcaaaataaaaggtgcaaagaaccaaggagatctccggggagtacatttcctacagggggaaatgtatgaccttccctttaatggccgaattgtcttccactttaggttgaagtcttcagagtgttcctgtttcctttcgcctttgaaatggcagtgtctgggatagatggtgtccgacttgctatgccaaatggggtaagcattatttttcaggagggtagattaggcaactctattaaagaggctgcactgcattctgtaaatggtatgaggctaagaggacatgtcctttgggcaccatccaagccggaatagaagccaattccaccatcgccttcactctggtctttctttctcctgcctattcaataatctccccaagctcttctttttcatagaactcaattattttcctttgatgaacttatacaaatttgaagtacaaattttctatggttttcttaaacaaatctctcttttgctgctctgtaaaatccataaggtctctgttgttatgaccagtgaccaggaaaattctgggcatgtgaagacctttgggtaggcatctgttgaatgggtgaattgatgaatgaatgaatgaatgaatgatgtaattaattgctaataagacccaagcacacagtatcaatcatctataaagctggcatatcaaagctttgttatatcccaaaagagttaacccagcacacaaggagggaaacacaacattttatttcattttatttcacctgtgccagttattcagataacctctaaaaactgtttaacattcacagtgtagccaaataaacagatgctggtaaacttaactccataaacggtttcactcaggagacagaggcacattgttttatcagagtttcaggatacgcgttgggaatcactgaatcctagagcggccaagggctgtgtgtctcagccctttcagatgtggggtgctctgtctctggagacccctggcttccacagtcctgggacttgtagctgactgagcctgggctgatttctctggtagttcttcctggatgtggcccaatgacccctgtatagatggattagtcagggtttgctgcagagacagaactaataggatagatatacatatgaaagggagtttattaaggagtattgacttacacaatcacaaaatgaagtcccacaacaggtcttctgcaagctgaggagcaaggaaaccagtctgagtcccaaaacctcagaagtagggaagccaacagtgcagctgtctgtctgtggccgaaggcccgagaggctctggcaaaccactggtgtaagtccaagaacttggagtctgatgttcgagggcaggaagcatccagcacaggagaaagataaaggccagaagactaagcaagtctgcttttccatcttctcctacctgctttatcctacctgtgctggcagctgatgagacagtgcccacttagactgagggtgggtctgcctctcccagttcactgactcaaatgttcacctcctttggcaacaccctcacaggcacacccaggaacagtactttgcatccttcaatcagtccagttgacactcagtgttaaccatcacagtagattttgtttgtgcccaagttcctgaaggctgtgtgtatccagacccgcacatagatcagcaggatacttgacgatctcaactggataatggaatcttttcacgcctcctccactttctttggaaacccatttttaagacacctcaaattcttctatttgaaacacttttctcaaaatcccatcaccaacagtgaaaaggattctggcaccaacaacactggaatttgaattgtttgtgctaagtggctgtctttttggaatgtcccctctctttaaccacttcccctctctgtggctttctgtctgctttcttaaaccctgggttttggaatttgatcattttgctcaggacatctgagcagttttcttctacgaagaatctgaggatgaaaggagaccacagactcctccagaagaaagaaataaggcattgcattaattcgtaaaactggtttcaaagacaaactggtatttataatcatctccggtagggttcatctcccatcccgcgtcccatataaaaattagtgagactgccaaaatccttatctttcatgttccttcttttcctgtgaaaaagacaagtgccaaatcttgttaactcagcacgatatatatgcctcttttctccctgggacttcgtgtgcctacgtcccttctgattcagggataagagattctgctttcagggtgaagtgcaactgaacgtgtttttggtgtctcgtgagcaaagccctagtgagcatgctttgtaaggtgaaatatgcctttgatatatgacagtgtttatatgtatagttaagctttttcagctttaacaagtctgagagtagtctttgagaagttttaggggttatataatgaagacaaagaagttactttatgaaagccacgtactaaaataattcatgttggtttgcatgaattatttatgtctggtgtgcattggaaatgctttctttttcagcgagaatcagttttcttagccttggctcctcagaaaagaagatcactccttatgttacagttctgtgcccattgtaaggtattgctgtggcgttttaccaactgaggagggtctcccacgtgtctgcgaagcctctgagtacttttctgtgctttttgcttcctctgtgtctacaaggcatgtgtgcaagtctccatcttgttggaagaataatccccttcctctcccatgagaggtatatggaagttactgtaggagcacacacacagagtgttgtgtttgagttttctggggctgctgtagcaaaagtgtcacagaccgggaggcttaaacaacagaaatttattctctaccatttctgggcaccagaaatctgaaatcaaggtgtctccgggtggtgctccctttggaggctctaggggagaatccttcctgcctctcccatttctgggggacttcaggcttccctgggcttgtggccgcatcactccagtcctgcctccatctccatgaggacttctcttctttatctgtgtctcgtcttctgtctcttacaggaacacctgtcattggatttaagagacccctctaaatctagccataatctcatcaatagattgtcaatttaattgcagctgcaaaagtcctatttccaaataaggtcccatccctctatacctggtgttaggatgtggacatatattttgggggccactgtgccacccactaccatatggacacttcctaactgatgtcagaatacatgcacttcccaatagttatatgctgcccggtgctttgatgaactgttgacttttggtttggagaaaacccacatgtctagagctctagctattccacagaacttaactcttactgggctctttccttttatgttcttgtaagacatgcttaaactgcttgagtgttatggttcatgtttcttttctttttcttgcagtgtaaagcctgttaattcatggccagttcaccaagaagtatcaaattcaattatatgaacactgttttttccccaaacaaatgcccttgtgttaaaaccacacacagcaatagcaatggcaactgcaacaattgcccccagctctacttaaatcacttgcatccccctattaccaatgtcaatcacctatggccactggaaggctaaggcagcgcatgcatagctattaataaaagtttttgctaaggattgacacattggtagtaccagctatgagctcacagtacaacacagttcaaacaaagaccatggatctaaatttcagagcttgaaagaagcaaatctttgcccagttaacattaggagtcttaactttttccaaggtaagaaagagagaaaaattttggctcatatggacactgttcactggatgtactatgttcagtgagcagatgtgtttgtgtatgcatgagctttggtggggttgtaatgttacttcttaataataattctgccctcatccgtttcctaggagacagaagaaaaatgaaccttacacttttgctggagcacaacatctagatttagttgccttggatgtgaaggttctatgtcctatttatccacacctctcagcggtgcccagaatgccactggcatatcatgaatacattgtcaacatctgttaagtgaatgaattggtcaatgaatgaatgcatttggcgtcatgtaaataagattcttcagggcatcagaaagctaccttatagagtaccaaattgggcatttgcttttaattcatgtcaaccaaacatttaaacatgtgctttgcccagaaatagagcatttgaaacagctaaatatatgccctttccaagtgtacttacctcagctgaggacatgttcagatgttacctttttctccttctagagttattctggcttgtcttcaggttgtgttagttgagttggtgcatttattgtctttgaataaaatgtcgtgatttatgttccctgtctgtcagccacaattctgcagcacaggagataagaagaattccccatgtgttttccatagcatttcaacttaatgcaaagttttacattagcacattcgttttcgctgtcacaaacagtcattatatgagcttttgtagcgttaatgtcattttatctcaattctgggaacatgcaaggataggaatttggtatgtcactgaaactgaatactcccaagttgccaaccagaagatttcagatctactttgttttactttgcatttacgtggctgttctccctacttttgtgtaaaattacaatgacacttgctgctttcttctaattttatggttctctatatagaagtgtagaaagttaaatggccttcagaatgaaagtctgtgttttatccctggcctaaattacggactgcatgttccaatccctggtctaagtcatggaatgcacgtgatatggtttggcagtgtccccacccaaatctcaccttgaattgtaataattatcacgtgtcaagggtggggccaggtggagataattgaatcatgggggcagtttccctcatattgttctcatagtagtgagtaagtcctaagagatctgatggctttataaatgggagctcccctgcacaagccctcttgcctgccgccatgtaagaaaaagacatggctttgctcctccttgccttctgtcatgattgtgagcctcaccagccatgtggaactgtgagtcaattaacctttttactttataaatgacctagtatcaggagtgtctttattagcagcttaagaatgaactaatacagcacatcctccccaaatccatatgtggaagccctaatccccaatgggatggtcttagtaggtggggcctgtgggaggtatgtaggtttagatgagataatgagggtggtgcctgcttgatgggattagtgtctttataagaagagaaagagactcagagctccctctctcctccatgtgaaggtacagagacatggcaccatctgcagaccaggaaggaggaaggaggccctcagtagacaccagatctgccagcatcttcatcttcccaggctccagaactttgggaagtaacatttgttgctcaagccacccagcttaaggcattttattataggatcctgaactaagacaccatgaatgtgaccttctatagcattagggtctttgtagatgtaattaagctaaaagtcttgagatgaggatgtcatcctggattatttgggcaaacctacctctaatgctataaccaaatgccataaactgggtggcttaaataaaatatgcacgaagggcaagagagacagaagaagaggaggtgatgtgagcatggaggtagatgttggagtgatgtggccacaagacagaacatcaaaaggcaccagaagccagaagcaaagaatggattcactctttgagtttccagagaaggtgtgttgctgctcacaccttcattttgggcttctggcttccagaagtttgagagaacaaattcttgctatcttaaaatttttttttttttttcatttccataggttttgggggaacaggtggtatctggttacataaattctttagtggtgatttgtgagattttggttcacccatcaccagagcaatccactgaatccaatttgtaatcttttatccctcacccccatcctgccctttccaacaagttcccaatgtccattgtatcattcttatgcctttgcatcttcatagcttagctcctacttatgaatgagaacatatgatgttcagttttccactcctgagtgacttcatttagaataatagtctccattcccacctaggttgctgcaaatgccattaatttattcatttttatggctgagtagtattccatggtgtgtgtgtgtgtgtgtgtgtgtgtgtgtgtgtgtgtacatatatatcatagttcctttaccaacctgttgattgatggcatttgggattattccacaatccacccagattatagtaatttgttacaacagccacagaaaaataacacaagaggtgtatgcatattttaggttttgtggttgtcattcattttaatgactggaacagacaattggtcaaaatcaattttagtaatgtgattgccttcctagagtgtcattgagctggatgttggagaactaattataatttctgttccacaatgactgtttttacattatgtttagccatgatttactacaggaattttattcattttatttctccatggcagcgtcacacttccctaataaatgtgacaccttttgcatggtgactatgtggtattaatgaagccagtctcctccttactcacctgatgtataaatctaatgttaatcaaatgcctgttattagcccagcattggaacagtcatcagcaatgaagcaatgagaaaacccaacgggctcctgggttgattgaggtaatctttcagtagaaataaagattgaaattacattcaattctctgtatttgtgatagttgtgttctataaagtcaccataaacactgaattagcaagttgtaaactattgctcccaggggaaatacaagattaggattctatgatgtctggtcacaacattttcatcaaccagtcaatacataatcttgttttatgcatgtttctgtttaagaaaaactttctgagtagatatttttgactcattcacactgaactcatgtccagcagcaccatgactcatgcctgagtaatgcttctctaacacagagattttctctgtgaggcacattgcagtccttttgtactagggaccccagacagcacttcagctctgttcttcaggccattttaaacagcaaaatcaccaacaaaaagcacaaacacgcaaaacacatggtactcaatggaccacaataattctacttgtttaaagtataagagctgaaacaagaaggtagggcatggccttgttccactgtagctgggaatgtgcactttgagcaatttatattttttccagctttgtgtgtgtgtctgcaaatgactgcaaaagtgctgtattgatttcgagattacaaagttttagtgagcaggcaagttcagaaagacaaaatttataaataaggaaaatcaactatacttagaaaacaaacagaatattcataaatctcaggtctgtaaacttttataattacacatggctaactctccagaccattagtcaactccatgccttcaaatttttgttgtatttggttattttctaatgagcattttggatgatag

SEQ ID NO: 823 - DNA, 250895 bp, Homo sapiens
tgcaagtcaaaatgtttaaacggctttttaaaatgagaataatgtcccagagacaggtcttaaaactgcacctaccttagctttggaagagctgcatcggccgttaagagttctttttacacgtccagatttttctagggaacccgaaacgaggtatgattcaggaggatgtattgaaagcccaggagccttccccttctggaaccccccaactagatttcctcatccagaggaatgcaagagccaccaacaccgcctagtttggaggaaattcgttgtttctgccgccaatagtctgtggacgggcagaacaagcattacaattgaagcaggaagggccaagctagtggctgaataagagctctgtgctaagagacagagaagggagagagacggttctgcaagaaaaagagagattgaggagagaggtcctgctgtctccggggctctccctctgccattggaccaaactgaatgaaatttacaaagccagcagccaatagatctccggagtcggccccatcactacagaaaccacatccacagctacaacctcatgcaaagagctgctaatcccaatgcaaaccagctgtaacggagagatcccgggtactcgggagatagagcaggtgggcatggcaaacggtgccaccgcaccagacgcgtacagcaaaccttcttcctctttgcttttttaggactctctagataccctccacaccaaacatgctgcagtatatgcaaacatctttaactgtttaaggtcacgatctccagcagtctctatgtctgcgttattgtaattcatttgggaagcaatgatataaaaaaaatttttaagagcagcaaaatttggaatacagttctgtaaagtacaggacctgttttatgctcagggtatggttgagaggggatcgatgaaagctttttgtttacttctattcttatactttcatgattttgataaaatgttggaattgtgcccaggatgaggcatttgtttttaaatacgcctcttcatttccagggtccaggaggttatctttcccagggagtttcaagttgcggggggcgaggacgggggtatgacccctgtacttaaagttgagttggagaaagttggatttaaattggcaatgcaaagatcagagggcataatagagtgttgtgacaatgaacacggattttaaaatgagattgcttgggttcaagatgcatgtgaccttaggtgtgtattttaatcgtttgcctccatttctgtatctgtaaaatggaacagataatcaccgtgtaatactgtaatgattagctgagttaatgtgtggggccaggtagtcttcacaacaatattacatggtgattacttttattcttctgcttggccagaaaagttagcttttcttaaaattatttcatggcccattaattcatttatggaaggaaaaagatagtgtccgcaacacataggatatcctcctaattgcttcggctttaggcagtaaaccaaagcatgaagcctgccatggtgatgtgaaggatatttgggcagcctgaccaataatggggaaggtgatagacaccaatttggggacctggtttcatgttaagactctatcctcacaaactttgccttgttgtaaagtcagttatgttctgtgaatctgttaaactgagattaaaattacctttcctgtggatttcttgtggagactaaatgaaataatatgtataaaagcaccttttaccaacaagataggtacataaatatacacttatctattaatagatatctatacccaataataaaaaaaaatatatccatccatacatacgtgtgtgttccaattattggatagatatttagaaatatgcatgtactttttccgttattgtatagatattgaagacccattaacatagtaatattgttaataagtatagcttattccccaaatcagtgatatacatggatatggatatatagctgcagatatatggacatatatatagatatctatatcctaaactaaagcagaatctcaccttgaacacagtaatttatagtaggccagaaagtcatgggttttgccaagaatgtattaattcattgacttattcataaattcagggttgttttttttttagcactggtgcagtcctaagcactgacatgcatctgtgagtgaaactcatccatttatttttgagaaagcatacagtctagtggacaagatagccaaaagcatgagaaaaaatatgattacaagaaggtgtgcacaaggaatacatatgaattcatagggacccatggaggtgaaaatgattaaagaagggtttgcaaaggaagaactttctgagtagggaagaaatggtacacagacactgattgggtcaagaagttgagaaagaagccatggataaagacatcatagcaatactgtatgtgtggagatctagaaatagggagggtttggaatgccatgacattgagtatgaaaagaaggtggtaaggaaaggattaaagacctaattgtgaagaattttgagtgccatactgaaaaggtggaatttatccagtaggcagtgggaaagccagtaacatattttctgcagggagaggggaagaaatgatcagatttatattttaggacaatcactgtgatggcaatatggagaacaagttgaagagggccaacgtggaaagaaaagaaaatatttgtaagattgttgcaagaatggatgcaacaaatgaagtcctgaatgagagacacagagagagaaagagaaaaggagaaagggaagggaggaaaaaggaagggaagggtagtgaagggaagagaagttgatgtggggagacatcacttctaaataaggcagcatgataaagtaagattgggaaggagagtttgggcaaaatctgaatgcttggcttagcttgtgggtggattggttgggtaccagatctcttccctgagatatgtgacctggaagagagcaggcaagcacattttcacttctatctgaatgactccattgagagttttttaaaataatttgaaaaatagggcaacatagtgagaccctgtttctataaaaaaattaaaaactagctgggagtggtagtgcaggaggctgaagggggaaggtcacttgagccagagaggtcgaggctgcagtgagccatgatcgtgccactgtactccagcctgggttgcagaatgagaccctccctcaaaaaaagaaaaaagtcagaaagcatcttagacaggtggaatcatgattgtaagaaaaagtgaatataagatgttatgaaattatcattttccctaatccaaaatcccttacaggagaccaggataggacccaaaacaccaatttttaacaactgggccaccagattgcaacacagacagaggagctacagaggtttagatccacaattcctggaagagataagagtatcattcttcatgcttccattttaaatctaattgtggagtatggtgaaatgtgggagctgggggagtcataaaatgaaataaaactgtagggttccaagaaagatatataagctgagtttggtacaagaactggagggaacatgagaaataatctataccacactacttgttctctctgattttccatctcagtgtctccatcaaccacattctggtattatgttcaagctcctgtgagatcaatacgtagaactctgaatgcaatactggtgaagccagtggggcactactgattcatactgactctcctaatacaatggtccaagtgaaacagaaatattttcagtaggataataattgttcgtgcaatagtaatatatactatgttattaattactaatcattattagagagagaaatatgtatagtatagaaggtgcttaaaatctaataagaggataaattaagctctttaattattaaaatgcaactcaatgtgtgacatatgccatctccaaagcatacagaaggcgtaacaggcttcctattgggatgctgagaaaatggttcacagatgaacaaggtttccctggggaattggagagcaggggtgggacattattccaagttaacaatatctggagacgagaaacagatatagtgtgagcaaaggctttggaagttcaaggtgcacaaggatgacccaggaagatggttacaaaatccatgcctctagagctaaacaccaggattcaaacctagcaggtcttgagtgagttcttggaacctgcatttggggggccaccctgctacatgaggttgcttttttagataatcctcaaattaaaccctgaaaacaggagtggtggtgagctgatgataggttcttatgattcatagaggagaataagaagaaattggtcaggctggactacagaggttgatgaatattcattggctggaatccttatgggtgttagtcggggatggtagcagagattacctttcagagagcttactctgaggggatttaagggctgggacattctagaacaaaagagtacagcgaggctgctgcattcataaattagggcagtattagtgaaaataacacagttatgatgaatttatttcactatgagtggcatttgactatatgcatagttgcagaagttgagcaaaaatgggatggagccctaaaatgagaagatactagagatagccttcatgtggtgagatgggaaggctaagatgaatgagagtgcactcagccagagtcacttgtgtggaaagaaaaatgaggtgctggtggatcatagaaataccaatgacccacagacctgagatctttgggacaggagatttgacctgaatagggatcttaaggtaggatctacggatccaagcacaaaccctatggatatgatacttaacattttggtgtaaaatagagaaagtgttcccttaagagaaaaggcaaatctttggagaaagtgacactgggtagggtcttgataacaacctaaaatagggtcattctcccatctgcagaagatctttggtaagagaaagtgtggtatggaattcaaggaaggactttaacctccacaaggagtaggcaggagtcaactgtgtcatggtcttcagagattttaggagtgaagggcgatgggagagtaccactgcattgtggaatcagtagatccttgacagccttcagctgaatatgttagatagattcatgactggggatccgatgaggaagttgaaatcataattatagtctgcctgtgaaaggaaaaaaaaagataaggtaaattcagaaatagcagggttgtggtgggtcattgttaagtggtttgctgattgctatttttattcactattcactaagcgtgaatgtgagaactgttgcttgttccacaaactctgcaaaatattcaagatggataaataagacatagtctttgccctcacatagctaattctttacccaatgccccttctgatccgaacgattgttccactttatttttattcatctgttagtttatttgtggtgtttcttactttcatttgctattgtagacaccattttagaaaaatatctcggaaacatgttgatgataattgccttaggtggtcaccattatatgaggccagttcagaacatgaggtttaataaatttgagaaatgataggacaaagagtaacatttatataatacttgttttgatacctatatctatctatatacacacatggaaatatatagatatagatatataaaaagatatagctatagatatttacatatagatatatatgtaaactagaaaatatctaaaaatatatatgtgtataaatcataaaccagggtaaacaacatactcagttttttagaaaacatttaagaaatgttattcccaaacaggatttaaagtcttttaaaatataaggtaattaacaacgtagattaaataagagtaatatgctgtaaaccttagaaatatttgcacccttaaggttaagcaaaattcattctgtcttattttacactccaaagttgctaaatcaacctttttctttcaatgatagcaagtaaactccagaccagttgaagctgaattatcataaatttaaaattaatgtcagtcacttaaataagattttattgaaatagttgaatgtatataacatttcttacatgtaaatataattacagaaatccagatggaggagataaagagatgctcttgtttattcccattggttttgtagggaaagtattttataagattaatacagcttgaaggaaatactttaaattgatattttccgataaaaaggttgtacatacccttaattcgatttttgcatctgatgaatgggaataaagatatctttgtgggcaagagtctatttctggtttcttgaagcctttgtccttctgacttctgttatttcaaacctgtaacacaccattaattatgtaacatgcatccacagtagagagttatgctctttgctggccttccatttgattattttaaattctatccccagttattatttcatcactgggcatgatgagcctaaatgacttttaaacggccctgatttttaaaaaagattcaggctccaaaatttcactacattcattgacggtgagaaatccattaactattgcttttgtaagaaaaccaaggatattgaatcccaaataagaggcccaaaatagagttcatttttaaatgacattctgcagcgactgtaccactgttcttgcctaagacttttaaaatgaaaatcttttacaatgtctatgtcgctttgatgaatgacaacatgcactacacttttaaaagtatggaaatatacataaatctttctccaagtttgggaccttggaattattgatatgcatgtatatagagagagatttagaaataggcatatagataggcttatataaattcataaatttatctctatatagatgtttatagaaattgctatgtctgtttcaatgtatatctgtatctctatctctatagatatctgtatcttctataggtatctatgacatatatatgcgtatctgtatcttctatagatatctatagagatatggatctgtctatatgaatagttatctctatatattgatacatatttatctatatctatatttatatctatatatatctatacaatacagaggggtttatattcccaggatggttgacttatgcctgattgtatctctgttgtgggtgtgcacatggactctcttcctgttttcttcctttgtactttaaaaggagacatttaacatgggggtaagacaataagaggcagcatcaatgtgttttatttattaaagctcaagcaaacagctttctttcttgttaatgaccggtgttagacataggtatgtaggcatatagaccacctctggtgaatgcagtgtggtttataattttaggtgaaataaaatgaggttgacaaaaaattcctaggacaatggttcccttttatcttttcaaactcgaggtctgtattggaatttttaaaaaacacttattttggttttttccaggtcttattcattgagaagacagggaatgtattgcaaataccgttttgcatgtgacaagtacacacatgtgtgtatgcatacatgtggaaacagagcagatgcaacatatgtataaataccaatgggattgttttgagtggggtttgatctgttataaagcattggtgtattaggagcctggtaatattttcctggaagagtcatgactaaaattatgtaaagaacacctggacccatgcaataccttgttcttttcctgcaaatatacaaaaagatctagagttttgatactttgctaaacaaattatagtcctcggtctaatatcatgggtgttattaatacctggaagcctgttaaaaatgcataactttgagcccccaccccagatcaactgtatcaaaactgcgttttaacatgttctctggtgatttgcaccaaacgccaaagttggagaagctcttgcctggaggacagctttgcatggcctcctaggtatctggtcatccaggctgagagttaaagtagcatccacccaaagggattttcatcttgtggccacgttgcttggtccaaggttgagcatctaagctgagccgggctatgggtatgcagtccctggaaagctggctcacaactgtgacactgcagtccatggacacagccacacacacagcaaatggtggctctagaggagtggacaggcaacaggtaaatttaggggccttcctggtcatgcttttccaccttgtccagtggaaaatggaggaagcttatatacaatgtacaaagtagatatgaagacagaaaggtaatgaatgacaaagagaagggctgcacatccttctacatcttcatcatattcttttgctgttcttgttgtttttcttttagagacagagtcttgctctgttgcccaggctagagtgcagtggcattatcatagctcactgcaacctcgaattcctgagctcaagagatcctgctacctcagcctcctcagtagctgggtctacaggtgtgtgcctccacgcccagctaatttttgtaatttttattaagttggtgtggtttttgcaattacttttaatggcaaaaaccgcaattacttttgcaccaatctagtataaagacagggtctcactagattgcccaggctggtcccaaactcctgacctcacaggatcctcctgcttctcagtctccctaagtgctgaaatgacaggtgcactctaccacacccggccccatcacattcttacctgtatgaatttcctaggcctcctgtaacacagtaccttaaactgagcagcttaaaccaaagacatttactctcccctagttctagagatcaaaagtctgagatcaaggtgtctgcatggccattctccctccaggggacctaggggagtatccttcctgtctatcccagctcctggtggctccaggcgtccctgggcttgtggccgcatcactccagtctctgcctccatctccctatggccttctcctctgtatgtgtcttcatgtgtctttttctgtctcttgtaaggacattctcattagatttaggacccaccttaatctggtatgatctcatcttcatccttaccttaattacatctgcaaagcccctgtttccaaataaggtcacattcccaggttctgggtagacatgaatttttagtggacagtgttcattttgctatactgcccttggaacctgtgagacatcctgtatccttgaacacatttccttttctgttttcttttgattaagcttatttaaatgggtttatgttacttgcacaggaagtgccctaattaatatgaaaggtgttaatggattttttaaaatgcgtcttcgagaagatgagcagtattaagacaggggctttgtcataggaaacttatgtaaggaagctgtctgggagaagtggtgtggtcggcttataactacacaagtatacagcttataaccacacaagtatctatctaagtggtagatagaccagacgttagcacagacatctgggcctagggttgccagatttaacagctaaaaatataggactcacaaaaacattactaaaagaatgttttgtgcaatatttgagatataattatgctggttttttctttgtttgtctcatattcaaatgtaactgagggctgggcacagtggctcacgcttgtaattctagtactttgggaggccaaggcaggtggatcacttgagttcaggagttcgatgtcagccgggccaacatggtgagaccccctctctactaaaaaatacaaaaattagcagggtgttgtggtgcgcacctgtagtcccagctactcagaaggctgaggctggaggatcacttgaaacctggcggcagaagtcgcagtgagctgagatcacaccactgcactccagcctgggtgatagagcgagactccgtctcacaaaaaaaaaaaaaaaaaaaaggtaatggcaacaacaaccaaaatgaaactgggcatcctggatttttatctggcaaacccatttatgccacataccacagaatgtttcatgcctactctgcttctagttgactctttatatcaggagttggttttcagtatgactcttctcttccccacacctaccataactccgtaactccatcttcaagttcaaaattgagccaataaatttgtggttacctacacttactgactcattgactgtagaaaaaagtaaaattatacaaaatatccctggctgaggtcaatgatgtcctgcttcctgatgtatttaatcttgctgtggactttccattctttgttaatgagacagtatttccatatgtccaataagccactctcttagtccgttcgggctcctattacagattgtcttagactgagtaatttataaaccacagcaatttattgaaggccagaagtccaagttcaaagcaccagcagactgagcatatggggagggttccctccttcaaagatgatggctgctgtgtgtcctcatgtgacaaaagagacaaagggatcatcttctgtgagggtactgatcccattcatgagggatcttatcacatcataaatggcctacttcttaatattatcatatggggaattcagtttcaaggtacaaatttggtggggaggagcattctgagcatagcagtcaggcacagcttcttggataattgtaactttccccaaggcagcttgcttttctcaccttctacactgccatgccttttcatgtttggagacgccttgtctctggactgattctagtgactcgctgagaattaacttcaaatttctgagctcatgcctaggttcagtcacacttttcgtcatcccctggcactggtttgttctcattgccatgaaaaccaattgcaatatccactcatcactctctcttttgcttgcacctgccgggccttagtgaaactccataaatacgtgttggcagaacagtgctagaactttatccttaatcagactaattacagtggatttttagaataatcaatctgatgccaagcagccacttcaaccagatctagttcattttgttgaaaaaaccacaaaatcattttcagtaatttgggagagatctagtacctataaaatcagtgtattagtccattctcatgctgctaataaacacaaacttataaaggaaagaggtttcatagactcatagttccacatgactggggaggcctcacaattatgttggaagacgaaggaagaacaaagggacttcttccacagcagcgggtaagaaagcttgtgcaggtgaactcccttttataaaactatcagatctcgtgagacttactcactatcacaagaacagcatgggaaagaccggccatgatttaattaccacccaccaggtccctcccatgacatgtgggaattatgggagctacaattcaagatgagatttgggtggggacacagtcaaaccatatcaatcagctaatctaacaccctatcatagattattaaagactggctaacaggtgattaaaatttagctattgattggtgcttgccaataatattataggaagaaaacctacatgaaacacacaaagccacagagtcatgctgttattatgctgtatttttcctggcacttgatgataatggaatgataatcataattaaaaataattggtgaaatctaaaagccacaatgtctaagtaccaatgagtacacctagtgctcagagtttggtttgtaataccattatccaataaaagaatccaggaatttataaagaaataaatgattctaggactcaggcaggaaatatccaagatgagcctggagcataatgtagttacagaaagtaaaaatgtgctaaaacagacaaaaatcaaagataaaaaaaatgcaatgataagagtatgtcaaagggacagaagaaccaaccaaaagagctcccaatggccagagttgtatctctttgagcaactgaataaataaagcagtattgtattataacccaaagaataaaaaatcatttatgagttcaatattgatatacacaaatgattgattatataaagaaattgggaagggtaacagataaatcattccaaataatttattcaggtatactgatatggtttggatctgtgtgtttagcaccgtcccctcttggtactgtatagtgggtgagttctcatgagatctggttttttaaaagtgtgtgccacctcctccctctctctctcttcctcccatgctggccatgtgagacacctagcttccccttcatcttctgccatgattgtaagtttcctgagacctcccaagaagccaagcagatattatcatgcttcctgtatagcctgcaggaccgagagccaattaaacctctttcctttataaattacccagtctcaggttatttatttatagcaatgtaagaatgcactaataccatagtccactctcatggaggggagcattaatccacactcctgaagtgtgggctgacatagtgactttctacctacagtttggaaaggagtgacaaaagagtaacttcacagtggagccacctggcaaacactacctcaaacaggtgggcaagatcaacatcaacagtgatgttatgttgatagtatgtacccctgatacgatgtatggtgactgtcttactgtcttcagaattcttgttaacccagtgctgtccttaagataaagcttatgaaaaattacagttttaaaatattaaagtggaataattgatgacatgagctttgcagacataatatgggaggtggcaatggtatacagatttttttcaaagaaagtcaactttatttttccacaacaacatgaaactaggaattatgacataggccatgtacggatgctgtaaatgaagtgtgtgtgctggtagtgggggtgttggcccatcctctgttgtctgtctttgaggtggctgtgggaaacccaatttaaaagtatgcatttctgggcattgtggctcacgcctgtaatccaagcaccttgggaggcccaggcgggcagatgacttgagcccaggaatttgagaccagcctgggcaacatggtgaaacccatctctgcaaaaaatacaaaaaaagaaatagttgagcatggtggcatgcacctgtagtcccagctacttgggaggctgaggtgggaggatcgttttagcccaggaggtgaaggttgcagtgcagtgagctgagattgtgccacagccctcgagcctgggcaacagaacccaaccctctctaaaaaaaaaaggaatgcactatataatgtgtgtatatatagtatatatagtgtatattatatatgtagataatacatgtaatttataaaagaacatttggctgggcacggtggctcatgcctgtaatcccagcactttgggaggccgaggcagatggatcacgaggtcaagagatcgagaccatcctggtcaacatggtgaaaccccgtctctactaaaaatacaaaaaattagccaggcatggtggcaggcgcctgtagtcccagccactcaggaggctgaggcagaagaatcacttgaaccctggaggcggaggttgcagtgagccgagattgtgccactgtactccagcctggcgacagagtgaaaaaaaaaaaaaaagaacattttatatatatgtaaagattatagactacaggcctggcacagtggctcatacctgtaatcccaatactttgggaagcagaggcaggaggatcacttgaggccaggagtttgagaccagcttggacaacatagaccccatctctaaaaacattgcaaaattagccaagtgcagtggtgtacaacaatagatccaggtactcaggaggctgaaggaggaggattgcttgagtccaggaattcaaggctgtagtgagttgcgattgtgcaccactgcactccagcctgggcaacagagcaacactcattctaaaaatacatacacgtacacacacacacacgcacgcacacacacacacacacacacacacagagagagagagagagaacataccacatattaaattttttttttttttgagaaagagtttcactcttgtctcccaggctggagtgcagtggtgcgatctcagctcactgcaacctccacctcctgggttcaagcagttctctccctcagcctcccaagtagctgggattgcaggtgcccgccaccatgcctgactaattttgtatttttagtagagatggggtttcaccatgttggcaaggctggtctcctgacctcagatgatccactggcctcggcctcccaaagtgctgggattacaggcatgagccaccttgcccagcccatacttatttttttgtttgtttagatgggttctcactccgttgcccaggctggagtgcaatggcatgatctcagctcactgcaacttctgcctcctgggttcaaacaattcttattccccagtctcccaagtagttgggactatagatgcgtgccaccacacccagctaatttttgcatttttagtagagatggggtttcaccatgttggccaagctggtctcgaactcctgacctcaagtgatctgtccgccttggcctctcaaagtgctgatattacaggcgtgagccactgcaccaggcctgtataccatatattacatatttatatatatttatctgtcctctactggattaacttggctttaaccaattcaatacttcaatgtttaagggatgccacctctgtggttagcatataaagattgtgacttccatcttgccatccagccttctgccttgctgattgatgattgaaaaaaaatcacctattttgttattatgactgtggaatgtcttttgttcattttaatatttgtgtcaccaaaaggatcaacgtggaatggatatggcattaaaggagaatgtcaaatactgcatgggatggctaaggcctgttccacacattctggggtgcccctgtgataataataggtgctgataaacttccatgttgagaaagttcacatatcgagagactaatagtgggccttagccagcagtcaatgagaaactaaagccctcagttcagcagtctgtgagaagccaaattctacccacaatgatgtgagttcaacatgagttcttccccgctggagtcttcagatgagacctcagccctggctggcaccttgatggcaccttgtaaataaactcaatgcagaggattcaactattttctaaattctgatccacagaaggtaagacatatgaaatgtgtattttttgaagccactatgttgtaatagactactattatttacatatgcatataaatatgtatgtaggaatagatatggatatagatgacaatacacaactttagcagataggaagagtaaaaaaaattgactaagttgaacaaatatgttagatattttccaatttgcaggattgctgctacaaccctttcagacacagcatagatgaatgaaccagagtaaaacgtccatcatctgctcataaagcctgccaaaatgtatcaaattaaggaagaggaggaatttgacaaccaaatctgtagtttctgcatcaagcaaaatagattttcttcactttgtctgagaatcgctttgctttcatcaacaatcttcatctttctacaattcatcacatcagtacacaattagcaaatcctcctaccatctgggaggccctgtgctaagcagggtgtgagaatcttagaaatattatgccattccaggtacttctaattttctgagctacatatacatggaaagttctgtagcaaggtttctcaagctgagcacaattgatatttgtggctgcaaaattctttgttgcagagggatatcatgtgcatttcagggtgctggacagcatccctggcctccatccactagatgctagtatcattcccccactcacccacttgtgacaatcaaaaatgtcttcagacattgctcagtgtctcttgggggacaaaatcactatcattgagaaccattgctctaaagcaaaacacaaacaaacaaaccatcaaaaaaatgacaaagaatcccttcttcaatttgcacaaccttgaaagccacccttggtaattcttctcaccacgttcccacaggcattttgaatctctgcgatatgtccaactccagtgcctttcagaatgcttaccagttctggcacctgtgtcataattgcagtaggctccccagtcattttgacaagcaaacactcactgtgtatttgcaaatactcttggtggaggagagaagggagtgttgaggttcctggccaagaaccactgtgaaaccggtaggtgttggctgatcaaatactgctagttgctgactagagtgtttcatgttccttccacaggagatgctttcttcttcgtggactgatgcatagtccccaaaaccttcttcaacacggcatcagcgcaatctcctttgacccacccatttcccccaaaatcccttcctcagaaaaattcatcatcccacctctctacattaaaagcaccttaaccttctaacagcacgtaattggcctacttgcaatggcacacacagtgtgtgtgtgtgtgtgtgtgtgtgtgtgcgtgtgtgtgtgtgggttggtgggggtcgccatccatcacactgtggattccatttccatatctgtccctaatggcttgctttaaagctatttgttttatatttattttttattctattttattttattgagacagggcctcactctttcacccaggctggagtgcaatggcacgatctctgctcactgcaacctctgcctaccaggctcaagcaattctcctgcttcaacctcctaagtagctgggattacaggtgcctgccaccataccaggaaaatttttgtatttttagtaaagacagggcttcaccatgttggccaggctggcctcgaactcctgacttcaagtgatccacccacctaggcctcccatagtgctatgattacaggcgtgagccacggggcctggcgaatttattttttaaattgaggtaaaatatacatatataatttactgtctttgccatttttaagtgtactgttcagtgggaatcaatacatttatcatctttttccccttcacatatttaacataatataatgttgaatttgccttcattttcttcagttcactttcatttggtacactgatccaatcactcaaaaaaatcaatagaaacttactgggagcagtggatattaccacatctttccatttacgttgtgtctttcttgaatgttgagattcttgtcttatgttgaccaaggtgaagtcatttgcacatgagatctaataaaaatattaatgtcattggccttctggtattaaatgaagtaacatgctttttattaacaacaggaaaggatggaagtcccaaataaacacagtttccacgcacatcatcataattcttaagttaccggcaccaacgactagcaaaattaagccattctgttcttagaccccgatggtaaagcgccctttgatagtaaacagggataaatatctataataggagctccttgcacatcggatatacaagactacaaaggaatctttgtttcaagttggccaattcaaagaaaataaaaatcatttacagattatatttttattcaaattggaattgtgtttcataacactaagaaaaagtaatttctgtctcccttcctccctctttctctctctctctctctctctctctcgtgcacacacacacacacacacacacacacacacacacacacccatcccacaacccccacccctccaaccacccttttcccccttggacagaactgggcagtgacaggcaaggactgtgaaatgtagcaaattcttctgcttcccaacagggacctgtaggctgccctttgtaaagttcaagctgtctcacactttttctttgagaagcccttggttttgcctgagacctcagcctgttgggacccatccttgtgtccagagttacacaagaggcttcctctcccaggaaagcaccctcctgactggcttcaggcatcaccctgggccacacttccagctcaagaagaggaggcaggatgaggaagaagatccagcggtaggaaattcatgcatcaagggcttcaccatctataatagcagggccccaacctgagattcttcaggacatacacaatcattgtattttctttttttttaaattttattttattattattatacttaagttttagggtacatgtgcacaacgtgcaggtttgttacatatgtatacatgtgccatgttggtgtgctgcacccattaactcgtcatttaacattaggtatatctcctaatgctatccctcccgcctccccccaccccaaaacaggccctggtgtgtgatgttccccttcctgtgtccatgtgtcctcattgttcaattcccacctatgagtgagaacatgcggtgtttggttttttgtccttgcgatagtttgctgagaatgatggtttccagcttcatccatgtccctacaaaggacacgaactcatcttttttatggctgcatagtattccatggtgtatatgtgccacattttcttaatccactctatcagtgttggacatttgggttggttccaagtctttgctattgtgaatagtgctgcaatcaactatttccatgtgtgtacacaaaagatttcatgatttttataaccctcttttaatatatctttattttaatttttttttttttttgagacagagtttctctctgttgcccaggctggagtgcagtggatgatctcagctcactgcaatctctgcctcccgggttcaagtgattctcctgcgtcagcctcccaagtagctgggattacaagtgtgcatcaccaccacacccaggtaattttggtatttttagtagagacagggtttcgctgtgttgttcaggctggtctcaaactcctggcctcaagtgatccacccaccttggcttcccaaaatgctgggattatatgcgtgagccaccatgcttggcacatttatttttatatatagctgaaacctccaaaaaataaaaataaaacaaaaccacatgtcctgggtttgaattccccctggccatccccaccggactagttccccagagcttggggagagtgattctgacactttagagagcttgcccctggaggagttttcccctttaattcttctgctctgtatgaacagaaaacctgaataaaaagtaggcagcaactgacaactcacgagacttttctcttcctgtgttggcactttaaatcacagaattagacgggcaagtacttcactgcaatgttacctaggcctcagacactgggtcttcctggggggtccatcagtttgcaccacacctgccttgtcagagaagcaaagctatcttccctccaatggctcattcctctaccatctggcttccttcgggccgcctttttcttaattaaggacatgcacttttcatttactgtggaggtcaaacaccctgcattggtttagaagctaaattaccctggttgaggactcctagagaagcaaacttttccctctgcatttcttgaagtggccggctatttgcagagcttttcttttactccatttccagtttcaggcttttttcttcagtactgtaggtatttttgttgttttcgtttgttttttctttttgagatggagtctccctctgtcacccaggctggagtgcagtggctcaatctcggctcactgcaacctccacctctcaggctcaagcaattctcctgcctcagcctccccagtagctgggattacaggtgcctgccactatgcctggctaattcttttggtaattttagtagagacaggatttcaccgtgttggcccacctggtctcaaactcctgggctcaagtgatctacctgcctcggcctctccatatgctgaggttacaggtgtgagttaccgtgcccagccagtagtctaggtattttaagcccacttactattttgctaaaatgaaaaattaaggacagaaagaaagcagaaaaaagcaagagtaaaaagataaagaagagagagacagatacacacataaacacacacagagagagagagagagggagaaagagagcaaactattaatacaaagataaatattttcatctggtctatgtaagattgagtctataaacagtatttaagatgttctcatctactcaaatgaaactgaccaaaccggaaggggaagagtgattcacttataatcagtgaatggggttgagttttccacatgcaacctcttcctgaatattttcaacaagtgcgagaagatggtctttgatctctccataacacagatgagaaaagtgacagttagagagtctgttaagcatgtcttgacctatgtagatcataatgctatgggtaggactttgaagattttttttctatccagaagcagaaacagcagaagacatgagcaaaatactgaagaagagtttcaaggaatatggcttagctaacaaggaatgagaaatgacaacagcaaatggtgttgttaaactattagactttccttcttgacagggtgatgtcaccctctagagagtgaaagatggtccttgaggagcaaaaaaactactctttttatatataaagatatacatagagtatgcaagcaaatgcacgatatgtctgctgtgtgaaaatcatacagttggcgcaaattttaaaaatacatctaaattgtctccctgggggtggtggtggggataatgaacaataggctgataaatatttctataaggcactgaatctatgacttaagggacaaattataaaatgtcaccatttcttcaaatagcatcaatagccactcaccaaaagtaagtaaataagaatttactgaggtggtggatatactcagtatggtgcttgacatgttaatttgtacaaaaaagggataaggtcgggcacggtggctcacacctgtaatcccagcaatttgggaggccaaggtggcagtatcgcttgagtgcaggagttcgagaccagcctgggcaacacggtgagaccctgtatctaccaaaaatacaaaaaattagctggacatggtggtgtgcacctgtagtcccagctactgaggaggctgaggcaggaggatcacgtcggcccaggagttcaagactccagtgagccatgatggcaccactgcactccagcctgggcactggaatgagaccctgtttcaaaaaaagcaaagcaaaacaaaactaaaggcataaggcatggtcctcagaaaatgtttatttatattgtgaggaaaatattctacatgaagtatggtggtaaatattaacaagtgggtatctggcagaggcggaagctttcattggtagcacttactgatttccaaagtgtatgtacttggattctgtccaatttcatataccaaagtgaaatcccagagcatggacatacaaagagatgtacattagtataggattttatagggtttccacaatgaagatgtaatagacttaaataacctcaagaatatagataactttaaaatgaagtacaataattagtcaatgaggagttttgagcatttagcaccttttaaaataatgtatctaattttaagattgtataattaaatttttaatggagactgtgtttaataatggcattttttaaaattctgaaatacgagagattaactctaatgagccagtgcaaaatgggtctaggagaccactgcaactattagggagaactggaagatgcaatgtgaataagtcttgggttacataggatgccttccaagaattaaaaaattgattaattgatgtccaattaataaaacagtgaaacatagtgtatagtcatagtctacatctatatatctacctgttagttgactctagttcagctttcccatttcagagtttgttgggttttgatggctcttcatgaactcggcttgtcccagttggctttattgtaattttatgtaaaataattaaatgattctgacaagcctggtgaaaatcctttcaacctgatcactttgtgctttgagcatggatggagccagaccttttcaaaggacccatgctttttggaaactgtggtttttatggaccgatcttgagttttaatatttggaagcttaataactatccaaaaatttacctacccccataaaacctaccatgtgaaaatacaaatttagactaagacctgacaagcaatcacaacagagacaaaaattgagaaatgacacttagtttaactaaagagtttctgcacagcaaagaaaactatcagcagagtaaatagacaacctacagaacgagataaaatatttgcaaactatgcatccagtgaaggtctaatatctggaatctataaagaacataagcaatttgacaagaaaagaacaaacaacccattaaaaagcggaccaaggacatgaatagacagttctcaaaagaagacatacatgcagccaagaaacgtgaacaaatactccacgtcgtgggtcatcagagaagtgcaaattaaaatcacaataagataccatctcacctaagtcagaatggctattatttgaaatgtagttttaaaaagtgcagatttggttataatgctattggagattggttcctgtcctcagctgaggccccttttctccaaaggaggtgtggtcaacttattaggagctggggatgggagtaagcgggacatgggcctaaaagaaactgagctattaagtgtggggctttactaatatgtttaggagacaggtattaaagttagtttcaaaagattaggtaatatcttcccataatttatagattttacttatttgttttaccagtgatatttaaatattttataacaacatgattaaggaattttatatttcaacaaaatgcacagtaaacaaaatggacacagtaattgtgacagcttcctcgttattaaagatgacagcaacagcccttgcccctagttcttcagtggaagatttagagagacttgatcttacagtacagttgggaatgaatcaggcacaattacagtagacattctcactcaacctgagtcatcaagacagtcttctgtacctgtcaatctaaatcaaggattggcaaacttatttttttatcacaagtcaatgtcatattaactatagtgaaggatataattaaaagcactttttttctgtgaacatgatagaagtttgttttgttgagacagaggaatataaacatgtacctcaccctttaaaggtattaacgatggtgacacaaaatttcagttgtttttagtgaaaccttttataacatttagttcttataatatcttctgctttctcttattgaagtagacatttcagtaaaagtaatatagtgattgaatttgaacatttgcaatggatgaatattttattttatgagaaaaaaaagacaggcaggaaacaatttatgaagttaactataggaatgtgctaaatttgatttcttgcattcagttgtctggggagttcacaggcagctttcaccaagaatactaaggctattatgcagattgaaaagccctactcctacatggtcattcatatttactttcacagagtgacagtagaaatgttctgttggtcaagtttgatgtttaaaaacatttatgaagattatgttacatttttaaaaaggccatgcaaaacttttggtatttcagctggggatatctccagaaaaggaaataactgatatgaaagacctttctgctggttctaatggcaagcttattatttctttaaatgtgttctcttttaactgtgattcatggggcatagctaacaatttttactggggatgaaaatcagataactacggtgaagagactatgaggaaaaaaaatgtgatggaaaatactttggctaggtttctgcaacactgtagaatctcatcaatttatatgtttggcttgtaataaagtcaagaaacttttggtggcaaattgcttgcattaggaatggctgggcatggtgactcacatctctaatcccagtactttgggaggccaaggcaggaggatcacgtaaggccaggagtttgagaccagtttaggcaacacagtgagaccccatctctacaaaataaagaaaaaaattagctggacatggtgctgtgtgcctgtactcctgctgaggcaggaggatcacatgagcccaagagtttgaggctgcagtgagccatggtctcaccactgtactccagcctcagcaacagagagagactctctcttaaaaaaaaaaaaaataggtagctaatctgcagtgtctgtgttttctcagggtgtgagcaatcattatttaattgcacttcatgaggagaactccatttcccctacttgcaaaacatttgggcccagcaccaagttgaaatactgaggtcttcatggatgtcgtaagattggcttcttctttgcaggtttcacttgtgattgaccttgagattgagaagtgccctcaaatgtatgtggggaagttttagtcgttaactagatttttccattctgctttggttgttaccgcttgggtggaattggttgtatctgccctgaatctaatctgagtcttacctattttaagggagtgtcaatcaaggccccagagagaattcaaccaaaaaaaatggtatcgagaaacccaaatagccacaatgaatccacttcactttaatgcttgggaaactgatgagggtttgccaggttgcccttttaatttccataggagcttcttctaagataagcaaatatataacaatattctcatttggaagagtgtcttcccttgggatttggatttgaaaaatgagataaaaggacaaattacctctcatattctcatgtcatacaaagaagattttcttactaaaccatgtgttgaaatactcaatagcaatgctcaaaaaaaatccatatacagatgaaagaaacatagtcatgaaagatactgcggatttacctgacgtgacctaaaactaagacagaaaattggttgcttctgtttctgggtatgtcagacaaaacacaatgtccaagttagtggaggaggttcaagttgttgttgctgttttttagaagtggatcggctctcttaataggtctgcagtcatctgaatggaaagtacactcaatttgttttggtagaccttgaaattgaacaaccaatttggtctagccattaaatcagcctcaatttgggctgggcatgaagacaaacttcaaccagtttgaatgatttttttgtgttgttttttgttttttaaacgttccaactctctgtttggcactatttttaaaaaaatttgatttcgtgactactgagagaagaaagcaagcacaccacggctttttctaggaaactgaaacatgaaaaattccgtaaagaattcaatttaaaaattctgatctccacttggacctaatgggatcttccagcctgggaaagcattccttcctcacattttattcttaaataaatctcaagctgagagtatacggaactttttctgtaggttctctgggccttaaacaatgaagtcatttatttaaactaattattttcattaagcagggtaggaatactgtgtgcttagttgctgcatttattatttattaagcactgagacttaattataccctgtactgaacaccaagaaatgcgttgtctgtctcagtttcattctgcagacaaaacagacaatatgagaaattgaacaccctaaaaactcttcattcttcctcaagcatttcatttaacacaattaacatacctgttatttataggcgggtttgctcggtgccataaattccaagtaaagggtctatgtcaccatagttgttcaaggcagtggagttagagattgtgtgtcaaaaatattttttaaagttgactggggagttgggtgattttttttcaccaaaacataaaacttaagtgaaaaaaataaataaaagtgaacataaaaatatttaaacattttaaagcactaaaacaaaagcaacatagatttggaatcataaaattgtttttttgagcagggtctcactctgtcatccaggttggagtgccatggcatgatctcaacacaccgcaacctccaacccctggcctcaagctatcctcccacctcagcctcccacgttgctgggaccataggcatgtgccaccactcccaattatttctttgtgttttttgtagagatggagtttcaccatgttgcccaggcttgactcaaattcctggcctcaagtgatctgtccacctcagcctcccaaagtgctgggattacaggtgtgagctaccattcttggcctggaataataaaattttaaagtgaattttaaagtgaagtggaatcttacttcaattctctgcctgttgaagagatttggagtcataaaacttttaagtcaacagttgcactgcaatcttacctaaactctcttcctgctgatctgtagcaggaggatgcagacaaattgtttcagaggctaaggatggagagtgcaggagaaccttgcaaagcaaacctggttcgttcaaatgaacagctcttcattgatcacaatcaacctttgaagtgaggaggtagtgctgatccaagcactacagcatgattttcaccttggggagaatcccatgatcatgactaacctgtggccagagagtcatttcgtactgtttctgctgattattcatacaaagacggaataagagagaacaagtctggtcaaaattaattgctttttctggaggtgtttgttgcaatgtgtgcaggtaataggtttcctcctttgaggcccaaagaatcaaatcctagccacataaactcttcgctatgatcctcattgataggaaacaacatggagtgcagtctctctctacattcctttgtatagcctgctcagaaatccacaggatttagtagtcaggcatttcttccagaagttccacaacaggtacacctgagttaggcctgaaatcaaggttttctgattctaagcctaatttctttttctttcttcctttcatgcattcgttctttctctctctttcttcctttcttttttctctttccaccttttctgccatttccttccttccttccttccctccctctttctttctttctttcctttcttcttctttctttccttctttcctttcttcttctttctttccttccttccttgtttctttctttttctttttctttcttgtttctttcctcctttctgtctctctctctctctttctttctgacagggtcttgctctgtcactcaggctggagtgcagtggtgcaatcataggtgactgcagctttgacttcctggactcaagccatcctcccacctcagcctccctagtagctgggactacaggcactcaccaccacacccggctaattttcttttttcttttttttcctttgagacggagttttgctcctgttgcccaggctggggtgcaatggcgcgatctcggcttacggcaacctctgcctcctgggtcgaagcgattctcctgcctcagcctcccgagtagctgggactacaggcacctgccaccatggtggcatttttagtagaggcagggtttcaccatgctggtaggctggtctcaaactcctgacctcaagtcatccatccacctcggcctcccgaagtgctgggattacaggcatgagccactgtgcccagcccaagcctggctaattttctgttaaaatttattttttgtagagccagagtctccctatggtgcccaggctggtcctgaactcctgagctcaagtgatcctcccacttcaacctttcaaagtgctgggattataagcctgagccctgcatcccactaagcccaatttctgttcaacagatgtctctttgggtgtagtaaaactctttaaatatgttacttaaagaaatctgactactgcaatttttgtctagtgggttagtgtttaagaatcatagccaaaaagattcttatccttaatggtaggactttgaaaactatggtgcctggaccaaatccaccccaaacctgtatttgtatggactgcaagctatgaatggagtttacattttacatgttgaaagcaaataagagaactttcttggcacatgaatagtatataaaatttacattccattaaaacacagtcatgcccaatccttcacgtagtatctgtgaccgttgtcacgctatagtggcagaattgagtagttgcaacagagatggttgtctttcctgcaaagcctatgctctatccaggcctttatggaaaatgtttgcaaactcctggttgagagaaatgccccttgagtgtgaagagtgaaatctttgggtctgatctgcaaagagagagctcagataaagcctgtgctctcataagaaaatcaaagattctaaagactggaacttctaacatttaaagtctccatcacccctcccccatgacccacaccttccatggttttgtcagagtgccctgtaggaggtctgaagtcactggggtagggtttgcggatggaaacctgagaggctgttgatatttatagtaggatggagccatggggcaggttcatccctaaccccaaatgaggactagaccgagggtggatgtctcctggagtccccagggatagtgatgagaaacgaaagcaggatatgaggtgggcccttcctccttcaatatgtgcctattaaaaggagacttcaaactacagggggatttagaaaaacattgtggctgacacctgggctaccttctgtagttaaaagagacagagtgttttaggtacatgaagtacatgattccatttatcacccagcaacctttcaattattaactttaatttgacctattatctttgctactaaatgttcagaacatctttgcctaaatcactatctaaagctatgttaggatacaggagggagagaggaaaataaaaatgttgatgaaaagtaccaaatggattgcgaagataatcctatttcacataaaatcattaaatgaatgttgttttctttttaattgctccacatttaaaaccaaacatgccgaggttagtactttacaacatctaactgaattttcctagttccttttattatgagactaggttctatgtaaagctgttgacttcaatgcaattattacattgttacacaaacgtatcattaatgaattgcagcaataatgtttatctaggctacttttctagactttttcccccttattgttgaattccaccaggtatagcaataacctcagtgtcagttgctgtactcacacaggtcagtagtcagttcatctttttaaattgtaaacaactacttgaaagctatattgtagctataataaagtctaaatttaattttattttgcgtaatcatcaattaaatcacttgcgaagtatttcaaaaaggacattaacaatagatctatgcgtaagtcacatctttatattgactttatctactgtagttctgctaaagcaaagaaaagcacttttctttccagagatttaattagatctgttgttctagcaaaggcattctaaaatccattttcaacctagaatggtttttaaaaacctgcacctgaaatttcagtgtcaacataaaaaaacagtaattagtgattgcaccctatttttaccttgtggtgtgacattcttttcatccttcatctcctgcctgggtgctttagggaactcataaatcaatatatttccaggtgccatatggttgctacatactattaggcaatgcttgagtagcacccaagacatttctaagactaatgtttcccttgcaaatggaaagttctaaatgtaaacatgttagtagcatagccatgaatggcaagtgcttccatcacagaagaaaatgaacacatattgctaataataacaaatgtgcatttctatgtccatgcacgatttctatggtcaagccccgggaaaacagaatcaaggctaaccacgtggaacgtagtcacatttcaaaaactacgatctgacccttggaaaatcagaatgcatgaaatcagttaaacagttatagagtctgcatgaacaggagtctttggtaatagcctaaattaggctaagatcagtggatttaacattttccagaaggcttgttcttaaatcaagggtgcaaagtcactctcttatgttttcgaatagtggttttaaagaatttttattgttgttttttttttatttgtgtgtttccaatttcctctcctagccaatgcattctgcatgttttactttttgtttatttacatattaaatcttagatttggaggtacacgtgcaggtttattgcatgaatatgttgcatgatgctgagatttgggcttcagctgaacccgtcatgcaaatagtgaacatagtaccaaaaggtagcttctctacccttccctactgaccccttttggactcctcagtgtctatagttcccatctttatctccatgtgtacccaatgtttagctcctacttataagtaagaacatgtggtctttcattttctgtttctccattaattcacttaggataatggccttcaactgcatctatgttgctgcaaaagacatcatctcattgattttcatggctgtatagtagtccatggtatatatgcaccacattttatatttccagtctactgttcatgggcacctagattgatttcatgtctttgctattgtgaataatgctcattctgcatgtttttatatgtggctgtagcattgttagacatttaaattccatatttttttatattcctttattgctggtgtataattgcacaatagacaaagaatgttgtctctatggatttgactacggaatttttgagattttgtttgtagcacaggttaatcttgcaaaataatttagatgcctgaaaaacaacaagtaatgtctctttttgtgatacatattgatatatcaatcagatgatgtttgttaattactacattgtaagttttatccttttctctctcttttttatttggtgggggagggttctgctttctttatcaactcttgacaaaggttcattcaatttttccactacagatgtggttttaaaatatcttttagtaattctgtcattttgtgtgtgtgtgtgtgtgtgtatatgtatatacacataaatatatatatacacatattcacatacacagacacacacacacataatatattcacatacacagacacacacatatttatttataaagactctcagtctcaatgtaatgagattttgattattatggatttctggtggcatgttttatttatgatgtaaaatccctaaacttctgttacctacttttgtcttcaattctattgtagatcaacttcattttgattattgcttttatggtatgcaagtttcatttccattattttcatatctttttttcatagacgtatcagtattaaatagtttagagctaggttatcattttatttagttttaattaaacctgagtgtctgtgcctttttaaaagggaagtttagcctttcatgtctggtgtgataatagataagtgggcatatttctactatctcaaattgtattttccattttttaccccctgacacttagctttctttttttccctctctttttctgacctctagggattttactcattggcggctcagttttttcacttgctcttttaaatattcagattttctaactttctagtaaacttcatagctcttatcctctttctgcacaagacaatggtgttaatgtacccaacctggtcaaggcccttccctacgtctcatcccttattaacatttcaattccagcttactttttggtataacattttaatattatgttaacattatctttacaattaacattatagatttaacaacatggctcatagtggcctttatttatcttgcacattgaagcctagaacttatttcattttatttatatttatatttatgataaagtatatcctttcatattgtctgtataaagatctggataaaacatttttggagtcatttatgccagaaaagtatctttctttcttttatgaacagttgcacaatggtagttttgtttggaattctgtattctcagatctcgtgcataagcatttcaaatatatggtgatagacaatatatttccaaggttatgccaatagtccccatagaggtgtccagacctgtgtgccattcccccctatagagtgtggtaggacctgtgccttgcttctagttatgcagaatatagagaaggtgaaaaaaaattgtgatgtaattaataacctcaaattagttgattttaagtaaatccagtgggtgattatcttgggcaggtctaacttcatcagatcgaaaggttctccttgtgggctcaatgatataagcacccatattggagaagcccacatgtccccttggctgtagtgggtagactttaaagtgaccctcaatgcctctcatcttctggtatttacacccttgtgcatgaggatacattccttgggtgtgtccaggattgtggggtgtgacttctgtgttttgtttactttatgccacataaaactcaatcttgttagcagactcttgctagagacttctcttgctgactttgaagaagtcagtcatcaagatgagagacccaactgtcaagctgctaaggatgacctaggatgggggactggtcctcgtctggcagcaagaaatggccagaactctcagtgctacagccccaagtaacttaattctgcaacaacctggctaagcttagaaccagattcttccttttttgaatctccagataagaacacaaccagccaacatcttgactgcatgcctgtgagacgctgagctccaaacccacctaagccatgcccaggtctttgatctgcagaaactgtgagataatcagtggtggttgttgtaaggtgctacgtttggaggtaatttgttacacagcaatagataactaatacatatctaattccattataacgtcagtgaggtgtagagttaaaggccctggttctgaatccaaacaaactttatttatctctgactcaatttgcccattaactaaagcaattaacagcccttctattttaagggctaagagctttaataaattaaccttttatccgtatcatgactattatcagagtgagtgacttggaataaatatgtaaaaaataactaaaattattgctgttgttctttttcctcaaagaactgatcatgctgagagattaatgttgcttagtttgtaagtttttctactcctgagaccaaatgtggagtacaatttaggaaggatttgccttaagagcacatgctttcagaacatctgaccttgtgttgattgtgcgacaggtttaaatattagatccttcttctcccaagatcttcctaattatgtgctgtttacactcacctccaaacctcagcaatctattgatttttgaagttaacacattgatttttttctctctgtcttttatatgacaatgccaaaaagcttttaataaatgggttgtggcctttatatgaactaacagaaggccccctgctggaatagctattaagttagcatccagacatagaagcaggatcatttataagaccttggcattggaactgctggtcatcagatgctcatggatgctcttgctgcaactcctgaccaaagtctgaaatagagtgctctccttcacttacgtaacattcaacatcacaatttttaaaaatattccaatatgcatcagagttctaataaacattagtattttgttattcattagcatttttattggggcacatgttagttaattttttaaaagggaatctcaattttccttacagctgttcaaactaaatagatcaagcaagaaaactaacacatacaaccaaaagttagatgactaacgcataacagtactatttaagttttcactcaatcatgcttgatttgttaactctcccaaaccactttgcttgactgagagtattttcaaaattaataaatgatcccactgttaaaaacgatcaattatcaacggctacattggctgaaaatttgggaacagatattgatagtttactatcatcttgtaataaattacacttcaaatatagaggcttaaagtaacatatgtttattatcttatagtttctgtaagtcaggaatctaggtatggcttagctgggtcctctactcatgttctcaaaaggctgcagtgaagcgggtagttaagctatgttctcatcctgagtctcaaatgtggagagagacattttcaaattcattcagaatgttagcataatttatttccttgcaactatgtggttaggggactttcattttgctacctcttgactagaggccacgtttgggtcatagaagctacccacactccctagaggccacccactctttcttgctacctgggtttctccaacatggcgttatttcatcaggtcttcaaagagaggctgtcacctcagtctttttcaggtcattctcctgattaaaccaagcccacccatgataaggcagacaactcaaaatcaactgattcaggatgtaaattacatctaaaacactcccttcacctttgccatgtttttggctagaagaaagtcaccattcctgcctatattcaaggggaattgaattgtataatgaaccactgaaccatgggactcctctaacatgtgtccactacagaccctgtgaataataaacaagaataaatctataatagtagaacattagtagtaagcacaaaatagctgataattaaatttacatacacacacacaaacacacgcagaaaagtcatcaacctgatgctgagatttgagtcttagtcctagttttctcgttaattttgtgaccttatataagccagttgaccccctctgagccttagtattattatttctaaagtgggtccttagaccagaaaaagatgtatactccctttcttctctaacctactatgattctttaatatccgtggtgtattcatgggttattgactggagaaaaaaattttgactaagacctcggctgcacgatacagtagacatatgtgactatgagcacttttaatgcagtgagtccaaattgagatgtgctctaagtgtaaaatatacatcagatttcaaaggtttaacaccatcaccaccacgacaaaaaagaatagagtatatctcatcaatatttttaagttgatcacgtgttagaaggattatattttgtctgtatttggttacattaaatattactaaaattgatttcatctgtttctggttggatattttaaagtgattcctgggaaattggaagctacatagtgggctacccttgtatttccattgcatgtcacaaagaactaggagttctttcctacctatttacattcacttgagggattctctttttggagagcagggagaaggaatgtaatggaatgaaactaaaattatatctacattagtcaaaaatttctaaatatgctttttttgtatttcaactgctttataaaaatatattaaaacttctaaatacatcagtgagagctcctattcagtttaatgtactaaatcatgtacaaacacacaaaatttcattcacatactgaactataccttgaggtcagatacaaggaaatattactttaccatatctatccaaaatgtttactatgaagatttaatggaataatagatattccacttagcccctcttacatatgaagctctatctattggattattttttaaatcattatgtagtttttttgaaagcagtgataatcttcagaaatattttctgtaatatatacacattttttctggacaattttacacgacagattggatcatttcaattgctaaaattactgagtcagtcaaacatgtgtcacaatcaccaattttgcaaaattatccacccacacactggctcttggctcagtcctaccatcctttcaggggcagagacaaaccaagtagtctatttctcctaatggatcagcgatttaactcaaagagttcaatgccgtagcccagaccgactgcagctgtgcattgtaatcagtggggaagggggataaaaaccgctcgtgtccagcaaggattgcacctgccaccaattgaatcaggacttccgcgacttggacctggtattggcattttaaaaaatatgctatctgggtcaacctaatgtcaatccagcattgatatcactgagtaacagattctagcttttgacctaaatatatgtatgtggggcagcttaggagtgaacttaaaagaaagaaaagaaaaggaaaaaatttaaaccatgctgtgttttgtcctgagctctgactttctcttcagctctcactatcatttattctacaattcagattattttttcaaaaatattcatattcagctattctgacatacccatgtttcttttgtcctgaaaaatatcaaaaaacagtcacatacacccatcagacacaggcagacattccttgcaaatagaaagatacaccaattccttgggaagcttgtactttcaccaaaactgaaacctcattattttttttttttttttgagattcatggctagaaaggagaaaaagggacattggaatgctgcaaacatttttttaaaaactgtttttgaactggtggagctttaacttctcatttgagagaaaacagcttctccttgggaaaaacaaagacgtgccttttttggatggaaaaggctgaaccaaaggacgcctgtattaatcttggttgcctagtaagaagaccccacgacagatccttggagaagcaatacccagatgtgatgagatgggcaaggattgttttgagagaattacccgtgggagcgaaaatgtttagctcctaaaagacacacgcatatgtatgttcatggcagagctattcacaatagcaaagacatggagtcaacctaggtgttcatccacagtggcatgcataaagaaaatgtgtgtatctacaccatggaatactacacagccataaaaaagaatgaaatcatgtcccgaatgagatttcttttcaccccaaagaggctaggagatccaccagacagagctcaatgctactctgacttcccataaaggaaagagggtaggagcaggaagattgggcatggtggtctgatagccctccagccaatgctggccaccacgggtcctgtgtctccaataaaggactcaccttagtatccctgccatcctcagtcattggggagattaagtctctaggaagaatgagcatgttgcaaatgaggtgatggatttcacagcacagcagcttgggatctcactaaataacattccctgtggtcaaggaaatgagaagcacatttttcatggccacacgagggccaatttgtcccagagggggaatttctccaggacccagagcatgggattgcggggcatgcatacctagaaacctgtttaaagtcattccttttacatattgtcactctcaactgcttacagccatgttgtacagtgtcctagattagaatgtgctatggtggggtagaggaaaggttagcacagcaacagcccaatggatgcctggcctgagaggacagcctaacattccagtgtaagagctcatggttgaccatttgatgacacacagcatgggaatggggacctttctgcgtgagtcctcctgattatatcttgttttgtaccctacttttccccaaggggagaaattggtatacctcatttacaaacgttgccttattcacattctaaaattgtgtctatgggaagtagtaaaatcccactgagtacatgcagtatttggttttctgtccctgcgttaatttgcttaggataatggcctccagctgcatcctggttgctgcaaaaacatgatttcattcttttttacggctgtgtattattccatggcatagatatgccatgttttctttatgcaggccactgtggatgggcacctaggttgactccatgtctttgctattctgaatagctctgccatgaacatacacgtgcatgtgtcttttaggagctaaacactgagcacatatggacataaagatggaaacaataggcactgaggactactaaagggaggaaagagggaggagggcaaggcctgaaaaactaacagttggatactatgctcggtacctgggtgatcacacaatatagccaggtaataaacttgcacatataccccctgaatctaaaataaaagttgaaattattttttaaaaattacaaaaaaaaagagaaataatcaaggagaaaatatataaacaaatgatacactgagtttacaaaaaagaaatcccactgagagggcacatgtcaattatcatctgtgggggatgagtttcttctggaaatttttatggtaatttcccaacttcagagggcttagctgtagggtacttttaaacctcaaattttccttccaagtttatattctgatcaaatctcattcctcgaagtagggttagcatatctttattgaatctcttgtgtttaacctctttctgcagttcagatgttctgttcatgactgggcaaaccaatgtctccttcctcactgttgtctgtagaaaaagtcagcacaagttctggagttagatagaagccttggctgaaatttattgtcttattcttgagggtagaagtctgaaatccaggtacgggctgcattggttcctttcaatgagcaagcatctgtttcagctctctcttttacctgctggtggctttctgtcaatctatagcattccttgacttatacaagcactatctgtgcctcaatgtctgcctttttcttcatgtggcattctccctattggtgtgcatctctacaaatttgttttttctacgaagatgcctgtcatattggattagagctcatcctaatgactgcatctcaacctaactaaatacatccacaacgatcctatttccaaatgaagtcacattctgagaagctaggaagtagtaggtcttcaacatatgaattttgtggggacacaattccacccacaatcctagttcattgcagaataagaactagagtccacagctctaagtttagtgccttttaggctgggctactaaggatgctcaaaacatggccaaagagtgactcaatcccgcaataaaagctggctcagtatttgaaagaagcattctgcttttgcattgtcaaatgacttgaattctgcagaagaaactctacagccaatttgataactatagattatctgaagtctatctgacgcaagaggctttgctgaactccgaaggtaatgagttcaaatccatatctcatggttacgtgcataccgtctactaatcatagtaatagccacctaggcaattactcactttttagtgtagaacaattaaataaatgtcagatactgtcttttctgtgagctcctcagatgcgttcttaacaattatagcctgtctgcttggaggcagcactgaacattgttggcacttggagaatactttcagtgtgtcatcatcttttccagaatttttagaacctggatagaaaactgtgaatctaagatcacaggcttttcttctttgtagctattgaatacacattttatagtccatagttttattactataaatggttccttctgtatttataaacacaaaacacagatgtaagatgtgatgtgctcagtaattaagtcaacttttatataacagtctgcttggatacggtgaattgtaacccagccttcagaatgcatgtaaaagatggaagttatgtctgataatctttagttgagactgtttctttttattttattttattttattattattatactttaagtttcagcgtacatgtgcacaatgtgcaggttagttacatatgtatacatgtgccatgctggtgtgctgcacgagactgtttcaaagatattttataccttcgaggaaaggctagcattttcttttttccagaaatcaactcattattaatctttatcttacaatgagttgcatatgaaggagcacttaactttaaagcacttcagtggagtctatgtgaatgagcaaagtgagtccccttgcagaattcagtgttttacaagccacttctgtatagtgttaacatgattattttacaagaatagggctcaatctagcactgtgttaatagaaatgaggcaattcatgaatatttaatcaatgatttacaccaaaagtcagaacagatatggagaaaaaattgcaagtgtatgaaaagatgtacaaacaagagtcaatcgttcttgaagaacagattctgagccacagtataagattgttgctgttacagttttctccagcaaccttctgcaaatagtctcattcacacatgcattcacccacccgctcaccttcccctcacacacaagcatgcacgcacttgcctatgcgtgcacaatctttttcatggctgcctactattccatgtctgaatcactgtcatttagctaacttctattgacagtcattttagttttcttttttctagtttttgtgatatttcaaaataattatgcagtgcaaacacccttcagcataaatctctgcatgatgtgggggtgcatctctcaggatgtattccttgaagtaaaagtatgtgctgggtcagaggctgtgtgcatcttaagcgtgggtctgttttcccaaatttccctcccaaggggctgcctgattcccagtcactatttaaagtgcttcctatgccttacccatctgttagattgctatcaattggaaggttaaaaatatggactctcactattgtttttatctgcattttggtacttacggggaaaaagaaaagttttcacttagttgaatttatatatctttctgttgccctcaaactccctgttcagtctttgttcctttgtggtaaatatcctggatatattttaagtttgccagcccacattctgttgtattttgtacatatttttctgttgcattttgtgtgtatttttctgttgcattttgttgcattcgtttgctagagctgccataacaaagtacgtagactggatagcctaaatagcagaattaattttctcactgtcttggaggctagaattcgtagatcaaggtataggaagagctggttcctcctggggcctctctccttggcttgtaaatggcaccttctccctgtgtcctcacatagtcatccctctgtgtgtgtctgtgtcccaagctttgcttcttatagggacaccagtcttgttggatctgggcccaccctaatgactttattttaccttaattatctctttaaagagactagtcagttctccatatctgttggttctgcatctgtggatttaaccaactgctatttgaaaatattcagaaaaaaaatggatggttgtgtctgtactaaacacaaacatcacatacatactttttttcttgttatcctcaaacaatggaggaaaacagctatttatatagaatttacagtgtgttgaataatgtaagtaatgtaggaatgatttaaagcagcgatccccaacgtttttggcaccagggataggttttgtggaagacgatatttccacggatgtggggtggggggatggggaatggttttgagatgattcaattgcattacatttatggttgcattctcgtgaggagcacacaacctagatccttcgcatgcgcagttcacaattgggtgcatgttcctacgagaatctaatgctgcagttgatctgacaggcggtgcaactcagacattagctcacttgcctgctgctcacctcctgctgtgtgactcaattcctaacaggccatgggactgataccagtccatgccctgggggttggggatccctgatttaaagtatacaggaggatgtccataggttaaacgcaaatactacaccgttttacataagggatttgagcattcatagatgttggtatccaaggggggttctagaatccatcctccaaggataccatgggtcaactatatctccaaatacactcacattctatgacactgagggttgggatttcaggatgtgaatttgggagtgcacaactcacaacgtgttaacttggctaagctatcatgtccggaggttgtggtcaacaatccacaaacagtagactttaagtgaaggaggcgatccttgattatgggattggccttgcccaatcagttgaaagaccttaaaaccaaaattgaggttttctggaggagaagaaattctgtctgctgactgcagcaccagtacctatttgagtttccaggccaccagactgctgttatatggattttcaacatgccagcctctgtaactcaatgagccaattccttgaaataaacacatcttcatatattatatgtaaaatacttctagataaacatgtaaatatatgtcatataacttacataatatacatatattaagacatatttataaattataatctatatattatataacataccacaaataatatataccataatgtcatatattattatatcatattatatcatatatatcattgtaatatattatatcatatattattgtaatatatagattgtaataatatatgtaccatatattagtataataatatatacactgtaataatatatatgccatatattattatatatggtatatacatatatatgtatcataaagcgtgagctgtggtcctgccaaccacaaacaagtcttcatgagccaccaaatttggttgaattttgacattgaaccctgctgacttgcatatataccatatatacagtacatactgtatacgttatatagtatataccatataacatatagattatatatatttatgtgtctgtatatggtacataatatatttaaatatataatatttatatacgtttataatatatattataatctgtaaatatataggcaatatgaatttgttttttttaagagacagggtctcgctctgttgcccaagctggagtgcagtggtgcaatcacggctcactgcagtcttgacctcccggtctcaagcaatcctcctgcctcagcctgccaagtagctgggagctcaggtacatgtcaccatgcccaactaagatataaatattgatacagatatccgacatgcttattggttctgttcgtctggagaatcatgaccggtacagatttattgcatgtattttccctcactatgccttgtctttttacgctgttgaggacattattgttatttagaaattttgagtttatgcagctgattttatcaattgttttcttgctggcttgcaggatttgtcctggaaggcatacttagctatgagcacacaaaagctctttctgaaagtttcatggttgatcaaacaatatctttcatgcgcgtccgtgtgaagtgaccaccaaacaggctttgtgtgaacaataaagcttttaatcacctgggtgcaggtgggctgagtccaaaaagagagtcagcgaagggagataagggtggggccgttttataggatttgggtagataaaggaaaattacagtcaaagggggttgttctctgtcggtcaggagtgggggtcacaaggtactcagtgggggagcttttgagccaggatgagccaggagaaggaatttcacaagacagtgtcatcagttaaggcaggaacaggccattttcacttcttttgtggtggaatgtcatcagttaaggcaggaaccggccatctggatgtgtatgtgtaggtcacaggggatatgatggcttagcttgggctcagaggcctgacattcctgtcttcttatataaataagaaaaataaaacgaaatagtggtaaagtgttggggcggtgaaaatttttggggacggtatggagagataatgggcgatgtttctcagggctgcttcgagtgggattggggtggcgtgggaacctagagtgggagagattaagctgaaggaagattttgtggtaaggggtgatattgtggggttgttagaagaaacatttatcatttagaatgattggtgatggcctgggtacagttttgtatgaattgaaaaacggaataagagaaggagaaaaacaggtataaaaggtctaagaattgggaggacctaggacatttaattagagtgcctaaggaggttcagcatagccttgccagtaaagattatttatttacttcaagagtttagagtggcagtttggggatagcaccaggagatatcagctgtgatggcttggagaaacagtgtaaaccggcagtgtaaacaagagcagggcatgtatgagtagttgagaacggtgaataggagtatgactagacagaagatagtagggatgacaagtttttttgggggcacagtctaagttggtccggtgtctggaatgagactggggcctaataaaaaggagcatctatacaggagctcaaatgggctgtaccctgtagcattctaaggacaggcctgatttctgagaagggaaagtggttaaagtattgtccagtcctttttaagttggtggctgagcttggtgaggtgtgtttttaaaagacctttagtccgttctacttttcttgaagaaggaggaccgtaagggatataaaggtttcactgaatactaagagcctgaaaaactgcttggctgatttgactaataaaggctggtctgttatcagactgtatagaggtgggaaggctaaactgaggaattatgtctgacagaagggaagaaatgactgcggtggccttctcagaccctgtaggaaaggcctgtacctatccagtgaaagtgtctacctagactaagaggtattttagttatctgactctgggcatgttgagtaaagctaatttgccagtcctgggtggggcaaatcctggagcttgatgtgtagggaagggaggaggcctgcataatccctgaggagtagtagaatagcagatggaacactgagaagttatttccttgaggatagatttccacgatggaaaggaaacgagaggttctaagaggcgggctagtggcttgtactatagcatagcctgcctttgctggtgtgtggcgattaggcctggtggaaccaccatcaataaatcaagcgtgatcagggtgaggaacaggaaagaaggaaatatggggaaatggggtgaatgtcaggtggatcagagagatacagtcatgagggtcaggtgtggtatccagaataatgtgggaggccggattgaagttcgggccaggaacaatggtaactgtgggacttaacaaagagtgagtacagctgaaggagccgggaagcagaaagtatatgcgtcaggtgtgaggaagaaaatagattttggaagttatgagaaatgtagagagtgagttgagcatagtttgtgattttgagggcctctaaaagtattaaagcagcggcagctgctgcaagcagacatgagggctaggctaaaacagtaaggtcaagttgtttggacagaaaggctacagggtgcagtcctggctcttgtgtaaaaattctgaccgcactaactatgcctaggaaggaaaggagttgttgttttgtaagggattgaggtttgggagattaatcggacacgatcagcagggaaaacacgtgtggttttataagaattatgccgagataggtaacagatgaggatgaaatttgggcttgactgaagtaatgggggctgtctgtgaagccttgcggcagtacagcccaggtaatttgctgagcctaatgggtgtcagggtcagtctaagtgaaagcaaagagaagctgggacgaagggtgcaggggaatagtgaaaaagcatctttaagatcgagaacggaatagtgagttgtggaggaaggtattgaggacgaaagagtgtacgggtttggcaccacagggtggataggcaaaacaatttggttgataaggcgcagatcctgaactaatctgtaagacttgtccggttttaggacaggtaaaatgggggaattgtaaggagagtttataggttttagaagcccatgctgtagcaggcgagtgataacaggctttaatccttttaaagcgtgctgtgggatgggatattggcattgagcggggtaagggtgattaggttttaatgggatggtaatgggcatgtgatcggttgccagggaaggagtagagatgtcccatacttgtgggttaaggtggggggatacgagaggaagacgcgaaggaggctttgggttggggagaagggcggcaatgagatgcagctgtagtccaggaatagtcagggaagcagataatttggttaaagtatctcggcctaataagggaactgggcaggtggggataactaaaaaagtgcagaaaagagtgttgtccaagttggcaccagagtgggggagttttcaggggtttagaagcctggccgtcaatacccacaacagttatggaggcaagggaaacaggcccttgaaaagaaggtaatgtggagtggggagcctccgtattgactaaggggacggacttaccttccactgtgagagttacccgaagctcggcgtccgtgatggtctagggggcttccgaggcaatcaggcagcgtcggtcttcagccgctaagccaagaagatctgggaagcagtcagacagccttgggccagagttccaggggctctgggagtggctgccaggtgagttggacagtccgatttccagtggggtcccacacagatgggacgcagcttaggaggaatcctgggctgcaggcattccttggcctggtggccagatttctgacacttgtagcaagctcctgggggaggaggttctggaggaacgcctggccgctgcggttcaggcgtttggaagttgtgtgctggagatgtggctggggtttgtctcaccgtggaggcaaggaattgcaacttttttctattattgtacaccttgaaggcgaggttaattaaatcctgttgtggggtttgagggccggaatttaatttttggagttttatttaatgtcgggagcagattgggtaataaaatgtattttgagaataggacggccttttgaccttttagagtctagggctgtaaagcgtctcagggttgctgccgaacgagccatgaactgggctgggtttttcatatttgatgaaagagcctaaaggctcacggatttgggagaggtctgataaagaaaaaggagcattaaccttgactatgcctttagcttcagccacctttttaagaggaaattgctgggcaggtggaggagggctactcacggaatgaaattgtaaaccagaccaggtgtgaggaggggaggggaggtgataaaaggattataggatggaggagtggaggctgaggaagaactgggacctagctcggcctggcgaggagcagcctggggaggaggggagaggtcagatgggtctgtagaaaaggaagattagaaagactcagcaatgcttggggttgggactgaggggacaggtgggagggaaagaaggaagatttgggacgagttgcactggggacagagactagggagggaccgatgtgtaaaagaatgcctggacgtcagacacctcagaccgtttgcccattttacgacaggaattatttagatcttgcaggatggaaaaattgaaagtgccgttttctggctatttggaactactgtcgagtttgtattggggtcaagcggcattgcagaagaaaataagatgcttagattttaggtcaggtgagagttggagaggttttaagttcttaagaacacaggctaagggagaagaaggaggaatagagggtggaaggttgcccatagtgaaggaagcaagcccagagaaaagagagcataaagacatggagggaaggggtttgggggttcttaccctccagaaaagcgggaaaggggtcggggcacagagatacgaggtcagggcacggaaataagggattgggatgcagagatataagaggttggggcgtggaaataagggatcggggcgcagaggtataagaggttggggcgtggaaataagggatcggggtgcagagatataaggggttggggtacttgccccacccctagaaaagcgggacttgccgctaagggtgaaggagaaggggttgggggtttcttaccccccagaaaggcggagaaggggtagagacaaggagagaaggggttggggtacttgcccctcctacagaaaagcgggacttgccgctaagggtgaaggagcaaggcaggcgtccctgcgtggtctgacgcctctgaaacatgggtgagttatcagagaggcgtccctgcaatgattaaacaccaagggaaggctgccttcccagtctgtgaccggcgctggagttttgggtccacggataaaacgtgtctcctttgtctccaccagaaaatgaaaggaattgaaattaaaagaagggagagattgaagtgtggcgccaagattgaaaggagaaagaggttgagggatagtgagggaggttggagaagagagtaaaaagaggccgcttaccggatttgaaattggtgagatgtttcttgggctggttggtctgaggacttgaggtcgtaggtggatctttctcatggagcaaagagcaggaggacaggggattgatctcccaagggaggcccccccaccaccatccgagtcacggcaccaaatttcatgtgcgtccgtgtgaagagaccaccaaataggctttgtgtgagcaataaagcttttaatcacctgggtgcaggtgggctgagtccgaaaagagagtcagcgaagggagataagggtggggccgttttataggatttgggtagataaaggaaaattacagtcaaagggggttgttctctgtcggtcaggagtgggggtcacaaggtactcagtgggggagcttttgagccaggatgagccaggagaaggaatttcacaagacagtgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacaatatctccttgtttatcaaatgtcatcctgtcactacatttgataatttgtaaaacatcagaaaatggtagcccaggtttaaagcagcagccttctggtgatctgtggctagggatacataggggagtcttagtcttcccagactgttgtaacaaagtaccacaacccgggtagttaatagaacagacgtttattctctcacggtcctagaggcaggaagtgtgagaccaaggtgtcgacagggctggtttctcctgatccctctctccttcgcttgcagatgccatcttctccctgtgttttgtctctgtgtccaaacttcccctttttataaggaccctggtcatactggcttagaacgcacctaatggcctcatcttaacttgattacatcatctttaaaggctatctccaaattaagtcacattcgaaggttctcagaacttcaaggtatcaacctgacagttgggggcagctcagctcctcacaaggtgggtagaattcagcctatggttctctgtcttcagtgaaaaaggcaagcccgagactgcaagctccttcacacagagtgagttctcatcccgccaaccacaagcaggtcttcgtgagacaccaaattggatgaattttgatgttgaaccctgctgactcttgtcagaggaagttcggttgcagcgaaatgctggttctgagaatttacaacttaaaggcagtcacagcccataggaggaaggtctcccaaagtaaagatggccttaagtggtgtggcatgggtgtctaaagcctaaaaaatgcagccatggctcagagagacatattgttcgtctggttcttaactgttcctgatgcttaaaaatgatgacaccatttaaataacctgcaaggagatgaaaaattccaaaggcatcttccgaaaactgcaaaggatagccattataatgatgtgaaggaacgggagaagaattatgagtgcaccctaagatgggagatattttcacccaaggcttagagatgtagtttaggaagggatagttttggaggaggaacctccatccaggactcagtaatcaatgcttaactttgaaaagggaaaaatagcagaccagcacacagggcagaggactgggtttgaaacaccaaatcttcctcatcttggccacttcagggagttagggaagctttctgaaatttttctggcacacgctgtacctttttgacaaaatttagggtgcctgcactggagacatgttttattaagttgctcctcgaaattctcttcttgcagaagttatctgacttgcagctgtggtgagtgtatgcaactttattttgtggaattccatcagaacaggtttaaagccattcagcattaattgggcccctttgcaaatactattggcttcttctgagagctggaagtctgcaggaaagccagagaaatagacaaatgaaaggtttggctagcctccgcatcccccaaacctactgagctgctttgcttgtatgccctgaatcagagaacggaaatactcgccaggaaaaaatacttgtaggagtctgactgtgccctgtccaattgtaatgaggtgcctctcgctgtttgtttagtatccttactgaaatccctactgtttttggtaatatgcacattttcatctccagctgtggagctaatgttcccatatttgttatgaaacacggagcattgtgtctttttccaggatatcccaaaagaaaaggtggctatggaatagttatgctgattagtgcatgcctcctggcttggaaagaaatcaggctggattcaacagaaagcaggttttgaaggaaaaacaacaataataacagcaacacttgagggcagagtgaaatgtgtaactgtactgatctttgcaggtttcacatcatcttgagaaacatgagtaaaagactggtagggaaactgttgaaaacagaacaatatttgctcggcatgtatgcaggaaaacgacgtttctgaggactcccgagcagtggagagaaagccttctggcaaattattgagagagtgaatcagttccccctctttctgatgcgcctcctaagcttaaaaataaagaggtgaaaacaacatgacgtttgccgtgcattgttgacatgaaatgttaaaggaagcctaatgttctggaagcctttttcttatagatgcagagacggcacaccccactgatctgaaagctcactgtgttactaagaaggtacatgcaccttattaatttaattcttacatccgttatttttcacaccatggaaaggattctaaaaataacccagagaattatataactcccatttccgtgatgctgtttcttgctttttttctcttctttgctttttttaaacaaacttccagacggattcaccttgagcggctttagctggaagcaatacgaaagatgtatatctcggtagacccttcttcattaagttctacactgtccatgtttctgggagttataatttaatctttgcaatcttggcagtgcaatttaagcagtgggttaagttgtaaaatgagtgttttaacatccagtgctctaacagtttgatgcaaatgtttttgcggcatttatgcaactcagattctccaagaaagtaaaagagagagagagagagagagatcatatttctgaggatgttatagaccaagctagcatcaaagaataagagaaaaagagctgcataaaagtcttggaggtaacaggtttggacaactttggatgaacagacatcctttaatgctagtctctgattccaattgctacaaaatccagcaggtatgttggggcactgtgcagcttggaagtcagagtttcacatccgcctcctctcatcattgttaaatcattttgtttcaaaaaggttttctttttatgttaataaaaagaaaagtcttcaagggcattttgttacaacaatgaaatttcaatttgtgattctaatatattcaaaagtacattggattgtggacttaagtcatcaatagaaccaaaatgtgctggtaaaacaacaactagacgtctccaggaatgccttgaaattgccaaacaagataatttaccttttctatttttttcagtgccagagaatgtgaataaattgtgatgtctcttaaaccctacatgacatgctctagtgaacatgtgattccagttagtgggtggctgatttatcatggcagtatttgttccgatttacttatcattgaagttaaataactgaatggaatctatttagttgatggaaatcaagaatagaaagaaataaagacatagtcaatgctgggaatctgtctttctaatggcttagagttatacagttcctacatatattttatcaagttaaaaaaattaccatctgtatttagtatgtttctttttaatgtaaattcagagattgcaagactctgctccctttcatccataaaatatgaattgctttcattctccttcttaagcaaaccatggcatcaattgaattaattgatccattttcacagcattcatcaaaagttcagtttaagggattagatgaaagtagccatatactaatcatgaaaacacacaatctcttagaagtatcatctttaagagcatatattccaaagtgatgttaatatgaaaagtcattgaatatcaatgaaaaacttggccacagtgattcagagcaaaatcttggagaatatgcaaaatatccttgtgtgattcttcctacaggtataggaagatgaagttttgtctatggaagtatggtttattttataaatgggaatagtgcttggattaaggtagcaccctgaccagccccggtctttcttcagttatactgtagaattttgttactgatacaactaaaagatctcaaagtataatttggggtttcagaataatggaaagctctctggagtcatagtcatcttttctatttttaaaaatcagagtctattaccatgcttggcacaaaagatgtcctcagtgtatatttattaaatggacgattgaatgaatgagtctaacctatgggcaaaacaccgtacctagcaatttgaaggactgctagccatagaaatagagaaacagagtgatctcaccatttaccaaaacccttgtgatgtcaaggagtttaatattggttgcctttctccataagagtaatacaaatgataatcagggaaacaataggatatatggaatagaatacaccaaattaattttgtattaaggagagtcataattgagagtttgttgcagctgattaataatgttccttaatatttctggaaagaaacagaggaagtcaaatcacattgatcatgggcttgggatatggacaaccttcttaaatactttcagaactatccttccattgcatatgttggttaattctctgtgaggctttattatctgccccgttcaaattacaaagaataaaatagaaggaggtttaatgttttggtgatatcagtagttggtaaacagcagaactggggttccaacctttccctcccaaatccagctctgaagctcttactcacttagtgatggctgttgactgaatgtgaacgagcttgtgctacaattgtcttagctgcagagattccaccaacatcagaaaaattcagccatgagactgagcagatccttgcaagaattcaatgcaattcatttccaattcactactttctcccttctttcttcattaaggtcatttatccagtcgtccatcctacaagatatctttattaagatctctagtgtttagtgccctacactgaactgaacatacagtggtcatagatgggtgctctttttgcctggatagaaactgtgacttaccccaaacttaaaaccatatgcatttatgatctcacagtttctgtgggccatgaattcagggaaagcctagccgaatcctcttcttagagtctatgagggcttccatcaaagtgttgggctgagctctcacctggaggttggacttgggaagaattcactcccaacctcaggtatgctgttgtcagatttgtttccttgtggctgcagaactgagagaccagcttcttgttggttatgggctaggagacaccctccactcttacgggccgtcctcagctcacatgaacacgggattcttcaatgtccacaggagagaaagtctctagagagaatggactagcaagatggagttttatgtagcatagagtttatatccatggtccagggtacattcagtggaagaggactatacaagaaagtgtaaactagaaagtgcagatctttgggggtcattttaaagtctgtccagcacaggaggtggccagaaatgtatcagacaataggaaactacaaaccatgatcagtattgccatgtacacacagcagaaaattaacaacaatagaaaatattggaggaataggaactttgcacaggacagaacatttaatatcatacctgaagaatgaggaggtggttaaatgttgcaagggtccgtgatgaaggtacaggattgtttatagacagaacagatggccaggtccttcttctacgttaagaattgtattagtccgttttcatgctgctgataaagacataccagcagcacgaaactgggtaatttataaagaaacagaggttaaatggactcactgttccacatgactggggaggcctcacaatcatggtggaaggtgaaaggcatgtcttaaatggcagcaggcaacagagaatgagaaccaagtgaaaggcgaaaccccttataaaacgatcagatctggtgaaacttattcattaccacgagaacagtatggggcaaaccgcccccatgattcaattatctaccagcggtccctcccatgacacatgggaattatgggagctacagttcaagatgagatttgggtgaggacacagccaaagcatatcaagaatgttaatgattacccccaaatcaatagataaccattcctagcctttccataatgatagatacaacctacctcatgtgatgatgatgatgatgatgatgatgatgatgatgatgataataataatgatgacgtgatgataaagttactgttttagctgtacaaatgactacaatttctatcacccttaaaattttatttcaatgccttggattaagccattactatatccagtggttctcttaaaatataaataatttgtttctaaaaaatagatattaagtcattgggatttcatcagaaattatttgtcaggtatgtgttggcttgcctctcttttccttacattcatgttacaaaatctcaaatcctggttaatttcaagaccttttttcactcttaactcctacataccctcacccccaccattctgcacacatcttcgttgttctacccatcttccagtgagggatattctcaaggaatgtgtctcagtaacaatcataataagcctacattaatggatgcctaccgtgtaaaagatacctcacatagaactcacatttaatttttacaacagtcctatcactttcacgttgcagattataagactgagggccaattaggatagaagtttcccagaccacccaggtgaaaggtggccaagccacagtctgcaggattccaggatactttcatgacgttggctcactcttttccagaatctcaggctatgctcaacacaatgctctcaaagacaatctcccaagcttgggtttcaattcctccaccatctggccttcaactgcatttccaagctctcagcatggttcaaacacgtcttctttgctacacatatcttaagtttcttgctgtttttcctttgttcatggggcttttaaaccttccaaaccatgaaccttctttcaatcaattgttgcaagttgcattcacaagacatttccatttctcttaaatcaatctttagtatctccttcaaaatcttttgtgggtcacactagagatcaacggaccctctcattcagttgaaggaagaaaagactgatgtagcaaagtcatcctctaagccatccacagggattgttggaattatttctcttgaccatagcagggcaaagcattcattggggagatgaatgtttcctcactttccttactttcagctcattatttctactagactgcagtccaactcagactctatagcagaactcaaaacctagaacttagtcaaccatgagatcacactgcctggccagtaaagactccctccaaatcagaaagactcaatggacattttgttggatatgacatgtagaccctcattcgagtatgaaaagatctagtccttgatactgctagtaactggaatattaacacttttctgtttaatttgaaaaggattttaaaatatatgtgtattgtatatataagtagttagatatccacacatgtatgtatcattgtgtttatatatatttgtatcaatgcttatgtgtgaatatgccaaactgtactttgctctattatctgatcatggagaaccacaggcttctgctgaatagtattctctgccagtcaatggtaactttttgatagactcttcctctttgtacagtgatgctaagaaggttctttgaatatcttactgattttgcctctataattttatttcttaaagggtaggaaatggaacaactagcatgctactactgcaatatgaaatatgtctcaaaaagtcaatgagattgaaacaaaagtgaaaatccttcagtgagatgaaaaatgtagaatctctacctcattgggcttaagcccactactgctgtttggaagaaaaagaaaaaaactaaacagcaagtatgaaatgctggaatagtgtcatcaatgattttttttctgaaagggatattttaatatgcatttttgttttatggatctaaagctctcttgttagtgggtaagttattgttggattttctcatatccaactttagtgttgatttttaggaacgtattgtataagagagaaatggctgcccatcttagttaaaagcacacttatattatgcgtactatgctcatctactggtaaattcctagggcttgaagagagtaaaatttactgtgtccatttataaaaaaaaataaaatgaaataaatccaagtaaagaatggaacttaaatgattttctatgatgggacactgtattagtccattttcatactgctataaagaaatacctgagactgggtaatttataaagaaaaggaggtttaatggactcacagttccacctggctggagaggcctcacaatcatggtggaaggtgaaggagatgcaaagtcacgtcttacatggcagaaggcaagagagcaggtgcaggggaactcccctttaaaaaaaccatcagatctcctgaggcttattcactatcatgagaacagcacaggaaaatccaccccataattcagttacctcccactgggtccctcccatgacacatggggattatgggagctacaattcaagatgagatttggatggggacacagccaaaccatattagacactcttgtgtggtttaaaaaaaacagcaccatttctctctcatttttacccttgttcctatttattttcttcttgggagatggaatgatatgagctatctttaattctttgtaacaacaacatttgcttccttttcactttgtcagtatgaagtattaccaagaaataaaaaagctcctctttgagctatgtgtggtagcaggggaatagtttttttttttttttctttatcatgcttgccacattttgaaactcaattttggttggatacatttcattcctgaattgtcaaagactcttacttcaagtaagttcaatctgccctctcactcaactttattcttctttttgagagacagagtctcgctctgttgtccaggctggagtgcagggctgtgatcacagctcactgcatcctcgaccccctgggctgcagtgattctctcgtctcagcctctagagtagcgaggaccacaggagtgcatcaccatgcctggctaatttttaaaaaatattttggagagaaggggtcttgctatgttgtccaggctggtctcaaactcctgggctcaagcaatccacctgtcttggcctcccaaagtgctggtattataggcgtgagccactgtgtgtggttttcaagtttattcttgttaaatgattttgacatttgcctttctataaaagtttgtaaaacaccctccccctccagcattgccatccttagattccttaggtaaagataatacttctactagaaaagaaaatgggtctgctgtagttctacagacttttaaataatatttctgtatctattaatctatgtatctcagaatgtaagtggtgtattttgccttttcaaagccaaggcactttctcccacaaggctgagtttctgcacacacgcagcctttgctcaagaaacagtgtcttcatggaatatggagattgataccagggttagtggctatggaagggtcccatgcggtatgacttctcttcccatttgatttagaccacattccataataacctcatgtagatgcagaaatagtatactctggtcagccattgagggccatgtggtttctgtattataatcaatgcatcaaagaagtataggaatctgtgatggggtcaacaattcagaaaccatccatttaccaaaagaatgtgtttttctatatatcctcccaagtagtgatcagagataatcagcaccaagtgttcaatttagcatttttctctcaaaactaaacttttgattttctgactcaaaattttgtcaaagtgcaagcgttgtaaaactgagaaaactgcctggttataaaatccttcagctttatccatgtattatctttgcagttttcctttaaggaataattaaaagagaggaggggatagtaattgcacaaaacggcagatagcaaagtagataaaattttaatcaaatcttttagtgttttgatagcaaaatacattgtaaatcacttaaaagtttatttaaacaaatttagatgtaagctatgctctttcgagaccatccatatttaatttttacattttataaaatataaccatgttttaggcagtcatacaaaaatggattaagacacttttttcatgtggccaaattcactgggcttgtttattttgcatcctaggcacctaaacacctagttcttggcactgagatgaaacatggactgttttttttttttgagatggagtctcactttgttgcctaggctggagtgcaatggcgcaatctcggctcactgcaacctctgcctcctgggttcaagcagttctcctgcctcagcatcccaagtagctgggattacaggcgcctgccaccatgcccagctaatttttgtattttgagtaaagatggggtttcaccacgttggccaggatggtctcgatcttttgacctcgtgatctgtctacctcagcctcccaaagtgttgtgattacaggtgtgagccaccacgcccggccgaaacatggactttttagaaaaaaatttctgaccatggttgtgaaaaatgcactcacctgtccaaacccaaggaatgaactcagagacatggagaatagcagaagcgagacttttaatgatggtcttgcaagattggatgtcgggtaggcagacacacccagtactgttacaacaagccatttatcccctagtatgcaagtccctccctcagttcctcataggctgagtactatgggatcacaatcttcccggatgtcgcctattggtctttgggttgaggcttttaggtattttctttagggttgtctcactgcattttgttgcagcccataatgcattacaatcatggtcagttctggggctcttcaagtacttcacttatgacccaggtagtcaggcaagctgataagaatagataaagcgagctatcttgcaggctagtaaactttcactctagataaaggtctttggttccagtgtgggtaactaagggggccctgacaagcaggtgccggctattaaagcaggggcctagtatatcctttgttccatagtttgtgggcccaagcctattagaggcacgttgtcttggaaatggatatcatatacattattttctacacagttgaaaactggaaagttttatgaacttggagtgacttcctgcgaggctgatgtaataattctaagtatagtaacatttcactctattttccttgaactaccagcatgaaaatataaaacatttacaaattaagtaaaaggtcctttcaaagacaaatgcagtaacacatctaaactgaaacaaaacatcctaaataaatacacagtaatagctaactatttatgtattgcagaaactcggtagctactcatcaaccgcaattcctcttcctgtggacacagggggaagaccacattgacaagagccccattcctttgggctcacaacctcaccaaagcctggtccaggagccagcaacatgaagcatcatcttggagctcataaaattgcacagtctctctgatgattagtgatactaagcatttttttcatataaactttcctgagtcaaaatggcttttattaaaaaaatgaaaagtaacaggccaggcatggtggctcacgcctgtaattcagcactttgggaggctgagacaggtggatcacttgaggtcaggagttcaagaccagcctggccaacatggtgaaaacccacctctactaaaaatacaaagaatttgcctggcatggtgatgggcacctgtagtcccagctactcgggagggtgaggaaggagaatcgcttgagcctgggaggcagagggtgcaatgaggtgagatcgcatcactgcactccagcctgggtgacagagggagactccatctcaaaaaaaaaaaaaaaaaaaaaaaaaaaaattaaaaaagaaaaagaacagatgttggtgaggatttggagaaaaaaaattcttattgactgttggtaggaatttaaactagtatagccattacagaaaacagtacggagctttacaaaaaatctaaaaatagaattatcattaatcccacaatctcactactaggtatctacctgcccctgaaaaaaagaaatcaatatgtcaaagagatacctgcacttccatgttgataacagcactattcataatggcaaacatatggaatcaacctaagtgtccacaaacacatgaatggataaagaaaatacacataatggaatactattgagccataaaaaagaatgaaattgtgtcttttggcagcaacatgggtggaactggaggtcattattttaagtgaaatcagccaggtgcaaaaagacaaatagtgcaggttttcactttcatgtaggagctaaaaaatttgaacccatggtagaagagagtggaaaagcagatacagagactgggaaggatgcatgggaagagagaggataaagagacgtgggttaaagaggacaaacatacagtaagatagaaggaataaatttgaagcttgatagcagagtagggtaactgtactcagcaaaaatgtagtgcagcagaatgatgaacaccctaaatacccgacgtgatccctatgtgttatatacatgtaacaaaatttctcaggtaccccacaaatatgcacaaagaaaaaatataaaacattaaaatgcagtctcaacctcatcctagagctgctgaatcagaatctgcgttgagacaagaccacctggtgaatcatatacacattaaaatacctactgtagagaaaagccgcccaggaccatttgaccagggacatctctgtatacgggggaaggaaatgcttgttgcactgagctgtggagttatttgatacaataactagcatgcatcctactcactaaaactcagcgaaaataaaatgttcttatggcttaccaattccacacctgtaattgtcttactagagcagaaaacatgtacatttatgcacatataaaatcttcttccctttctcttggtatatatacatttaatttcaatgacaccttttcttatgttatagtcatcttcacccaccttctcttaatatattattgtcatcttcagcccccatggaagagaagcagttaaatattctgaaatctctgtaacatgtcatctaggtccttacaatttagaaatgatggagtatcctcagcaaagaagggcagaggtcttcctcaaggtcaagtcaaggttcatgcatagactctcaagtcaacacaaatcagctcagggaaaaagtgttttaacctttgtcaaatttttgttatagggagcaacttagcaggatatctgctttaactcagcactcttcaagatgtttggttttaaggccattttactctattaaaaatgactgaggacctcaaataacatttataatgtaggttatatttatcaaagtagaaacctaaaaacatttgaagtatttatattattttattaaatttatatataataaaccctttgcatgttaatatagaaacatttttattaaagataataatttttaaaaaccggggagtaagaccacatggttttgtagtcgcactaatctttttagtgggcttgatcaaagacagctggattttcttgtctgcttctgcattcaatctgctgtaatatcacatgtcatgcggcctctggaaaactttactgtaaacttaggagggaatgagagaggggggcggaaaaggcaacactgtctggggctatcatgaaaagctttgtgaccctaaggactccttgaaagggtcttgcagacactcagcgtttcccaaaccacaatatgggaatttctgttcaactgggttgaatgctggcctttgcgtgcagaatagcagaaaaccagcatcatttctgtcttgttcagggttcagtacataatgagaatgctaagcttcttgttcaaaaatagtattagcctggtcaacataacaagaccccatctctacaaaagtaaaaataaaaaattagctgggtgtggtggcttgggcttgtagtcttagctattcaggaggctgaggcaggaggatcccttgagcccaggaatttgaagctgcagtgagctatgatcctacccactgcactgcactccagcctgggcaacagagcgagacactgtatcatgtatacatatatataatatacatgctatatatatatatatatgtatatataattttaagatatatgtaattaattttaagaccgcaacaggaaaacattaaaaaccaagtgcggggggcccttctaagtgtgggttgcatgtcaacgaatctagcaaagctggaaatataattgcatctttccctataatggagggcagttaacccagctgggcttggttgtgcttatgattaacttcattgcatcccaggcttcgaatttgtccaggggtaagttgctgttaccgtgggcttagggtggaatctaagaggcacgacggttttcttattgtttcttttctcccctcagcttttggcttctcctgctctctgcatctcacaggaaagacatccttttgtactctcccaccttccctagcagctcattgctgttacttcatagtttgtgttctgctggtgatggagattgagtgaaagagtaggttctgttttcctaatctagcctctgattgaggctggtcccgtgttctcagggatgggaggtgagactctccctttcacagcagccaaactcagggaggaatctatggttggccatggtgggaggcaattcatgctcttttcgccagaggcagcagagcactgctttatattaggataagatcttggggccagatgagttatctgctccttttctaaaattagaggatttgtcttctattcttacactggctatgaaggaagggttttcgcctgggctataatggttgatattgtttgctgcatctcttttcagtgatttaagtctttgtttccaatgagtgaaggagtcagggaagtttgtgggtgtattagtcaggggtctctagagggacagaactaataggatagatgaatatatgaaggggagtttattaggagaattgactcccacgatcacaaggtgaagtcccacaataagctgtctgcaagctgaggagccagaaagccagtctgagtcccaaaatctcaaaagtagggaagccgacagaacaaccttcagtctgtggctgaaggcccaagagcccctggcaaaccactggtgtaagtcctagagtccaaaagctgaagaacttgtagtctgatgctcgagggcaggaagcatccagcatgggagaaagatgaaggctggaagactcagcctagtgtttcccattcttctgcctgctttttattctggccatccaggcagctgatgagatggtgtccactcagattgaggggaagtctgcctttcccagtccactgactcaaatgttaaccttctttcacaacaccctcacggatacacccaggagtaatactttgcatcctcaatccaatcaagttgacactcaatattacccatcacagtgggactttgtggtttttcagaaattttctcagaaatcactacaaagtgacttcacttttttattgacagtgaaactgctggtcattttcaggcctacacccttttttttttttttttttccagagagagggtctcattctgtcgcctaggctggagtgcagtgggcagtggtataatcagagctcactatagcctcgaacttctgggttcaagcaatcttcccacctcagcctcccaagtagctgggaatacagggtctctctgtgttgctctggctggttttgaagtcctggctcaagcaatcctcccacttcagcctcccaaagtgcttgggattccaggtgtgagacaccacgcaccgcatgcctacgtcattgaagtggactctctcgtatctcctgccctgcctccaagctgtctcatgagaacataatgaggcctatcgagagacgggcagtaggcagaaacttcctttgtgtctgggattctagggatattaaaatttttaaaaaggtaaattccagactctcgtgaagatataaagtaatcatgtgctaagtattttattttacttattagttaatgaggaattggtaaaatagacaatcggtttgcatatttttggtctgataaagaacactaaaatgaatatacaaatggttgcgtaaatgaccagatgctagtatttgtttcctgttgcatagtgtagccaagttgacgcatccagaaaacatcacactggcaaaattcacatggtgaaaaccaatggcatccaactagaaatcatttgcatcgcttcggacacaaattatttgctttgctattggggttctataacttagagagtcataaaatagcctggtcaaggccaatggaggcagaaataacccagatggatgagatagttaggacacccattccacttcaaagtctttcaaaatttttccctagagggacttgcagctatttcagatagacatggtcacacagtggacctataaaaattgtttaacatttcagctgatattgttgtatttgctattgtaaaggctggccttccctccccagttgcatacagcatttctccttggaaggccttgtcctcttcagagggcttaaggcaagttacaagtgtgtaggctctccatctctctctctttttggtgggagtgacattctctgcacttttctacaacccaaggagatgtgggaggaaagaggttgttgcatattttgatgctcaggctggttccacacagcagctttgttgtggaggtgttttggggaataaagcagagtgagctgtgatcacataaggactgaagtagtgcagagagaaaggagtagtatgaaaaatcccacagagacacagctgcaggcagtggaacaggcagtaagcaggtactggaggaacgcccagcaacccctctgccttaatcagaactttccaattacatgcgtcttcctttctttgatagaacttagtattattattaacctcctgagacagaatttttttttttagtaattgccaatggtttggggcagacattaattgcactggaatattttcactgcacactttcaggaatagaaataataaaatgagttgcactctaaggaacaaaaaacaaatagaaataatctaagtgaagtgggatggtaataatgcctacatttgcaagatgcttgacagttttccagggatttgcaccaacaggaatatctgagttgggggagaaaacacaacaacattagtaaaggttcaatgtgcagcacagcctgtcttctactgtgaaatagttgtcctttgatttattaagtgtagctaaatttatattgggtttatttgtataaaccatcttcaattcttttttttttttttttttttttttttggcgagcaggcaggttagcaatacgaaaagcaatgttattcttctgctacagttacatagaaaataggactcctaatgcttattaagccttttcagggttgcacctttgtgagcggtagacacggtattagaactcaagataaccttctttctcatcctcctactctttgcggttacagaaacttgcacttcttataaagaacacattttacaatgaatctaggccacttgtagaagaaaatgccacctgtgtatgtgtgtgttacttgtctttaattcgagataaagcatgccactgtcaaaaagtgaagttgctatatctggcagaaacttttgtatttcttttgaattatttggataattgtctccaattctttattcagaagtttatgcacaaacaggatgtaatctcaaattcctaggcttgcctcttaaacttgggaaactcaattgcattcagcatagcttattcccacctatatgtgctcattaagttgttcatgaacatggtcttcaatgaatgaagctgacgtacttgtttttcaagtgactatggcttccatttatgtcttggttttgtttcatcattagcataatcaggcatgtgtagatatgtagggtgtttggaagaatgaagatgaaatgatggaaagccggagacatgtacttatagtacaaactccgttttttatgagcacagacaaaggtttgcgaagacatggagaggaatctctacccatgtagatgcagatggccaactaccactcatcccatacttgtaactcatgataaggctctatcgtctcttcatctctgtgctagattcaaattatacatttttttcctctgggaaaggcattagcaaattcatttttttgttatcagaagtgcccagaaaatttagaaatgtctaatttgtgtgtatctctcacattgattgatgtatatgtgttctgtgtcacaatgcattctttattattatttttattttttttggagacagggtcttatcctgtccccaggttggagtgcagtgctgtgatcatagctcaccgcagcctccaactcctgggctcaactgatcctcccacatcagcctacatagtagctaggactacagacaggcacctgccaccatgcctggctttttatttttttatttttttgaggcagagtctcgctctgtcgcccagactggagtgcaatagtgcgatctcggctcactgcaacctccgcctcccaggttcaagtgattctcctgcgttagccttccgagtagctaggattacaagcacctgccaccaggcccggctagtttttttgtatttttagtagagctcaggtttcacaatgttggccaggctggtcttgagctcctgacctcatgatctgcctgcctcagcctcccaaagtgctgggattacaggcgtgagccaacgcgcccggcctaattttttatttgtatagagattgttttgtagagattgggggtctcattatatttcccaagctggtctccaactcctggcctcatgcgattctcctaccttggccttccaaagctctgggattacaggggtgacacactgttgcagtcccatagtgaattctgatggtgcaggcaagggcaggtcatgctttggaagccaccaagcctgagttccagccatgacacagccactcatgagccatatggccctgggtaagtcatgtcacttttctaacctcagtgtcctttatatataacacagtaatagtaatactagcctcctaaggttgttcctataactaaatgggtgttaggcatgtggtacgttactcaattaagagtatcattataaatgtttccagtaatccatgtatctaatgaacataggtttcttaaagctatccagtgatttcaagcaaaagcaagaagggagaagagaattagatatgattagaggcaaggatttgttttcatcctccacagctcaatgtcttaaacagtgacaccatgattcatgttgagtaatagcaattagctaaatgtctgttattaggagggccaatggttttatgtattgattttcaatcatgaggaggactgccatgccatacttcctgctgtggccacaccccatgttgaaggatctactatggagagttcttgtttttattcccggagtgctgtgtattggaccaaggggagggaaatctgacctaagaggaagaatgaggccagacacatcaggtgcggtctggtatgaagagatgacacagactaggggtaggctccttctagaaataccaactagaaaacacactgggaaagtgaggtgttaaagaatgagaaatgagctcacccaaatgtggaaacagaacgaggaaggaaaaacagaaaccagagatcatactagacaacactctaaggaagcccaaacttaagaggtagcagcagaagctatgaggtagagagaaagggaagagatggggggaaaaatgaaagagctgtgaagtcacacagaaaggatcaaacacaagcagaggctggaaagtagaaacacaaaggaagggatcagcacctgtggggttgtgacagtgccagcttggtgatcatgtccaggtttcctgctagcccatgaattccttgaaaatacattattttatttttaagatgatttgcataattatgttaatattttaaagatgatttgcataaatatctgttgcataaatttattgacggacaaaacatcaataaattaaataataaagttttgtttttctgtatgaaattaatgcaggctaactatagaaaactttacatttcttttcttttttttttttttttttgagacaggttctggctctgttgcccaggctggagtgcagtggctcagtcttggcttactgcaacctctgcctcctgggctcaagtgatccttccacctcagcctcccaagtagctgggactacaggtgcataccagcatgcctggctaatttttaaaaaaattttttttgcagagacaaatctcactttgttgccccagctggtctcaaactcctgagctcaagccttctgcctgccttggcctcccagagtgctgtgattacaggggtgagccaccatatccggccaaaagtttacatttcacatattgaagagggaaaaaaataaaagcattatagtaagttccctcaaagacagttactattaacatgtggctatatttcaaaccaatatttttcaagtgtattttatgcattgttatcatattcatatcaaattgtattttactggttaatacttaatatggtatattgtatttcctaaatttctacgtgcttttcataatgtttatttttgatatatataataatccactgaggttgatgtaatatgacatattcaaacatgtacccacagtagatatttaaattgaccctttcccactatcattgactttgcttttccttcagagatgaaatgaactatgcctacaaatgacaccccacaaccattttccttaacagctctgcatagttttaaaatcaccttatggcatttttttcgtggaaaaacccccgaggataagctgtttttttcttccattttttaggtcacttatgtttcctgcttgaatgaatgtatatgattctttccttttccatgaaattcttggcaagcactcttagtcaccaaactcaattattttctcagcttaaggaaagttttttctacgatgtcctcaatatttactcccttccttcattggtcttcattttcttagtccccaactactctttgtagcttatagtgatgttctgcagggtactgtagcctcaataaatctaatacattctcttatcattaaaaaaaagctccattttcttcaccttggtatccactctctctaatcgccatgcatattgctgcattgatctctctaggttttactttttccttatgaagatttcaaaacagatcttttttcttgtgataacatttctgaaatccaaaaagctttctgaacttgagactgttatttactcacctcagcccattccttccattcctattttttttccacagaagccatagaattctatatttaataatacagagcagtcattttcaaagggtttctctttgtgtcactcaaatgaattcatgaggaatgcttccctgtgtgtctgtaggaattgcaaccgttgtctaatgttttggatttgtgtctaaatctttgttactctcccaccccaacccacttattctgctacttatctctccagcttcacctcttgtggctctttgcttctgactctgctttttagcagtgatgaaccacttgcagtcccaaaagtacaccaggctcctttcttccgcaggatgtggcatgggatattgacttcctgggtcatgcttccctttccccacatccctcatgtccatcctcatctattccttttcagtgtatacgttatctctcagaagaccatccctattgttctaagggatgttcccagaccaccgcgttaggggttcccctaagtatttctgagtactcgtcacataacgtaattccccagtctattttaagctacacaaaagtagaaaaaatacatcttgttcaccagcctctttcagtgcccagaacatcatctcagggcattttaaacagtagtgattcaacatatctcttgcatccattaattattgaataacaacctctttgagtgaggtaagatgtggaatgaggtaagagctgtaaaagcctgatgtttgcagaaaatgtacaaagttacagcctagtcattggaaggttttgtttcaaaatccaattagtattatgaaattatgttatgccacttctaagaatagttttgaaacaaatcaacatttctgaaccaagtttcagcatgccaaaggaagaagcacgactactttcagagccattgaagtgtatcagaagtttttcacgtatgctctgttggaatcctcgcaagtactttgtaaactggctatgagtagacccatgttgaaaataaggaaacagaacagagaagtcacccatctcttgggaagttgttcctggattgtagtttctctgagtctgcctataatgtgcttactaagtttggaaactcagacttttcccctccatggagagatggagctgccctcttttgaagatccctaaggacttcccttgattttgagaactgagcttctttctcttcaccctccaagctctatgtcccttcaaattgcttctggtctgagggcttgtactcagttttgacaacacaccatgcaaatggaaggtaagactcactcaaggtagatgaaattcccctctcccttgcttcctttattacagaggataatattccttcccacagcttgctgccacactgcccatgttgcttccaacaacagcaccatgtctgagaactatgctgtgcaaagtgagacgtattctagtattctactctgccatgaaacttttagctaaattcccgtggagtagatgacaaactttccagtacatgactactatgccacaaacaaccagaacagtaaccgataacacctcattcacagtcaactagagggaagacaaaactgccaacagctgtggaggtgaatctcaggattcctaatggctcctggtagaaatgctgtccatgtgatatcagcctaggcttgatctctgtggtctctgtctttctctcccctgtttttcatctgacttagctggggctgatacagcagaatactgggtggcttaaacagcagaaattcatttctcacactgcttggaggctgggaagtccaaggtcaaggcaccagcaaatccactgtgtggtgaaggctctcttcctggcctgcagacagctgtcttcttgctgtatcctcacatggtggacagagatttatcgtctctctcttcgttcttcttatagggccactaatcccatgatgagaactctgcactcatgacttacctacctcccaaaggctccatctccaaataccattgcagtgggaattaaggcttcaccatataagtttgggggttggggatagagacacagactttcagttcatgacttcatctttcttcattttattcttgatcttttgaccaggtcttcttataaccacccagtgggttcaccttgcttatggcctagacagagccgatttatcaagacagggcaattgcaatagagaaagagtaattcacacagagctggctgtatggtagactggagtttttttattactgaaatcagtctccccgagcactggggagcagagtttttaaggacaacttggtgggtgaggggaggcgcgtgagccaggagggctgattgatcaggaatgaaatcatagggtgttgaagctatcttcctatgctgagtcatttcttgggtgggggccacaagatcagatgagccagtttaactatctgggtagtgccggctgatccatcaaatgcagagtctgcaaaatatctcaagcactgatcttaggagcagtttagggagggtcagaatcttgtagcctccagctgcatgactcctaaaccataatttctaatcttgtggctaatgttagtcctacaaaggcagtctagtccccaggcaagaaagaggtctgctttgggaaagggctgttactgtctttggcttaaactataaactataaactaaatttctcccaaagttagttcagcctacacccaggaatgaacaaggacagcctggaggttagaagcaagatggagtcagttaagttagatctctttcactgtctcagtcataattttgcaaagacggtttcactcttacgtcttaaacagtgttgacttactgactggcaatgtctgttatctcagaatctcaaatttactttaaaaagcactgaaaattttactactctaaggtcttttctaatctctagaatgatcaacagataaaataaaattgactggctatatatgatccctttgttgtggaaaaggaaatatttatcaagagataccaaaggacctatgtaaaacaaagaaagttggagcaatgcccattaatcttttcatcttgtagcgtatagctcccagcatgttttagagtatccatgattactgtcatgatttacgttctttttattttgtatgtttacatatttgacaccgtctagatgatgttggtttcaaggaaacattcactggaaactgagttggcagggaaatggacaaggtcatttgagttatctttcttatcactcaaatctgtgctttttttccagtaaaggagtgggtgtgagctaccagcattgtggcttgtgctgggaatctatgcttctgatggtgctatttttagtgagtgcctgggtatattcgaaatgaatttgtttgtatattattttttaatttaatttaatttaattttaagttcccagatacatgtgcagaatgtgcaggtttgttgcataggtaaacgtgtgacatggtggtttcctgcacctatcatcccatcacctaggtatgtagccccgcatgcataagctatttatcttgatgctcttcctccccaggcccaaccgacaggccccagtgtgtgttgtcccctccctgtgtccatgtattctcagtgttcagctcccacttataagtgagaacatgtggtatttggttttctgttcctgtgttagtttgctgaggataatgacttccagctccatccatgtccctgaaaagacataatctcattcctttttatggctgcatagcattccatagtgtatatgtaccactcgtttgtacatttatccaactagcacttatttgacatttctggccaatgaagtttgagtaaagacatgcttattctgcattcctttctttaattcaaccttaaacaagtgaaatattgaaacctgttgccagggggtgaaaaacacttccctcttcaatcattgtcttagtttgttatgtggtgctgtaacagtataccacagatgaggtaatttatcaagaatggagatttctttcttacagtcttggaggctgggaagtcgaagattgaggggcccacagctattgagggccttcatgctgcatcatcttgtggtggaagacaagagtgccagagagcaagagattcaactcctggccccaagcccttttataagcagcattgaaggccaggcgtggtggctcatgcctgcaatcccagcactttgggaggccgaggcaggtggatcaggaggtcaggagttcaacaccaacctggccaagatggcgaaacccagtctctactaagaatacaaaaaattagctgggcgtggtggtgggcgcctgtaatctcagctacttggaaggctgaggcagagaattgcttgaacctgggaggcgaaggttgcagtgagccgagatggcgccaatgcactccagcctgggcgacagagtgagactctgtctcaaaaaatagataaataaataaataaataaataaataaataaataaataaataaaataagcagccattgatccattcatgaggttggaggcctcaggaccctcaggcatctctccctaagccccacctctgagcactattgcattggagaataggtttccaatacatggacttttgggaacacatccaagccatggcaatcatagaaaattggagccaggtgcaatggctcacacctgtaaccccagtactttggggggctgaggcaggaggatcacttgaagccaggagttggagaccagacttggcaacatagtgagaccccatctctaaaaaaaaaaatcagcagggcatggaggcaggagcctgtggtcccagctactcaggagactgaggcaggaggattgcttgagcccatgagtttgatgctacaatgagctgcgatcacaccattgtattccagcctgggtgatagagtgagaacctggctcaaaaagaaaaaaaaaaaaaaaaggccaggtgcagtggctcatgcctgttatcccagcactttgggaggccgagttgggaggatcacttgaggtcaggagtttgagaccagcttggccaacatggtaacaccccatctctactaaaaatacaaaaattatctgggcatggtggtgtgcgcctgtaatcccagctactcagaaggctgaggcaggagaaattgcttgaacccaggaggctgaggttgcagtgagcccagagtgtgccattacactccaggctgggtgacagagaaaagactctgtctaaaaaaaaaaaaaaaaaaaaaaaaaaggaaagaaataaaaaaatgccacattcagtaaatcttgcctgctgcttgaacatgaaacctgggtgaaaataataaaaatacaaagaattatggagccaaccaatgtcttttcattcttgagaaagggaatgcagaaaaggcaagcaactttccaaaatcctgcagctggtaagagagttcctctgataatctgatggcaggaggagaatgcagagaaggaaaataaaagcaccaaaatgatgaaagccaaggggtcatagaagcaaaatagtctaagtagaacagaaatgactgagaacagtcaacactgtggtaaacaagcttgaagaattgaacacacacacaagttacactactgtaagagcaagcttgttccctaatagcctcatatattattcaggatttatgttcatatagtattttaaaatttgaattacagtatatgctacctggcaaaaactggttaactgttcaggaagccgctttcttctttcctaggtgcattggggtgcatgtatccagcttgccttgcagtgaggtcctaggttacaagatggtagcagaattcatgtgtgccactttcaggtctcccatataacttcctgacaatatgcatcattctttcccctctttcagattcactgtatatgagaaagaaaattatggtaccaaaacatggaagggaattggcacctgaattattcctcaaaggagaatcattttgctagtcaagattactcatttggatttcatatcacaagaatgagaaaatcatctcttgtgtttgagctattttacatttttgtgtgtatttcatgaactagtgttactatacctaatccagtgcatgaattttcgtttgctatgaaaaatagagtgaaatattttcttcacaactcaaccaagcccttgaagagagttgaaatattcctagcattcttctacatcttcttctttctcctactttcttgactaatttgctactaggaagtggtctggattcagaccccaagagagggttctcagatctcccacatgaaagaattgggggcaagtccagagagtaaagtgaaagcaagtttattaagaaaataaaggaataaagaatggctactccataggcacagcagctccgagggctgctggttgcctatttttatggttatttcttgattgtatgctaaacaaggggtagattattcatgagttttctgggaaggggacaaggaattcccagaactgagggttcctcttccttttagaccttatagagtaacttccagacattgccgtggcgtttgtaaactggtgtggcactgttgggagtgtcttttagcaagctaatgcattataattagtgtataatgatcagtgaggaagactagaggtcgctttcatcatcatcttggttttggaggattttggtcagcttctttactgcaacctggtttatcagtgggatttctctgacttctatcttgtgcctacctcttatctcctatgactaagaatgcctaacctcctgagaagacagcccagcaggtctcaacctcatttgacccagcccctattcaagatggggtcaagcttgttcaaacacctctgacaaattcagtcctgaatctacaggatgcggttgagaaagacaggtgccaaaaccggggaagggaaagtgccccagtggtccagagaaagaggtgagagtcagtgtgaggatggtgaccatacaggaagactacttggtgtgaggtgttgaagtttaaatgaggggaagggtgccaggcatggtggctcacacctgtaattcaaacactttgggaggccgaggtggaagggtcacttgagaccaggagttcgagaccagcctggccaacatggcgaaacctcgtctctactaaaaatacaaaaaaaattagccaggggtggtggtgcatgcctgtagttccaggtactcgggggactgaggcaggagaatttcttgaatgtgggaggtggaggttgcagtgagccgaaatcatgccactgcactccagcctgggtgacaaaacaagactcaaataaataaataaataaggggagtgggcatctgtcttgggggaagatctgatagctgctatggaggattggatacatatagaggggaagggcaaataaaaataagcacaaatattaggaacaatgggagccaaaattccatcagataagggaattacaattaaggataggaaagctagaatgagcatgacggtatggatatagaattggaggtatcagaatcaagtaatgggcttgtgatagtctttttgagagataaagaaaataaatataggtacttgttgctggggctcagaaaccaataccccaaaatatggcattttgacatgctgaactgaagaagcctcaaggtctctctgatgacctccttcctcaaccttctctcccgaggaacctgaagttcccttatctgcctaaaattcagaaccccaaaggaaaacaattgttttttcttcctccccgttatctctttatctgttgcagaaaagaccaggatgtaaccccacacctgagcagacctttttaccacgataatgagtgtcttccaaggatcatttaaattccaaagagaactctttacaaattaatctctgttctcctcctgtcattctccctacaaagtatttgttgcccctcaatagaattcttctcctccccccacaccgccccaccacctgttttaacaggatccaagtcctaattctttctgtaatctcagggtggcatataagcttctgaaccggattaggaagttgagcttcactcttgtgtctcccatatatacacattaaataaatttctattcctcttctcctcttaatcaatctgcctcatgtcagtgatttttcagcaaacatttagggggccggtagccatggaccccatcgtatatatgtgtacatattttagttctgttcactaagagactctgggcatgaggacactccaatgttaatgagaacattgaggatccagattttgtcttctacacattattattcgtttgtagattccagggctccttggaaaaattgcagaatcctgggctgagtcaggagcagtgtaagatggtaattaggaatataacatatcagaaaatattcaaagagtcatgagattatggtaaaagatgcaagccaatttggagagctaccactggccaatctgggtacagtttgagtatcaaaacaactaatcatacttgtcaggcctctgagcccaagctaagccatcatatcccctgtgacctgcatgtacacatccagatggccggttcctgccttaactgatgacattgtcttgtgaaattccttttcctggctcatctggtctcaaaaagctcccctactgagcactttgtgacccccactctgcccgccagagaacaactcccctttgactgtaattttcctttatctacccaaatcctataaaacggccccacccctatctccctttgctgactctcttttccgactcagcccgcctgcacccaggtgaaataaacagccatgttgctcacacaaagcctgtttggtggtctcttcacacggacgcgcatgaaaatactaatggattataagttattgagtgaaatgagaaacagcaagttcatattgatatggataaagtgagtagaaaatttgatgaggaagaggatattttcacagtttgaaggaactgcccagtggatactgtgatggctaatattgagtgtcaacttgactggattgaaggatgcaaagtattgtccctgggtgtgtctgtgagggtgttgccaaaggagattaacatttgagtcagtggactgggaaaggcagacccaccctcaatctgtgtggacacgatctaatcagctgctagcgttgctagaatcaaagcaggcagaagaaccttgtgatgattaatactgagtgtcaacttgattggattgaaggatacaaattgttgatcctgggtgtgtctgtgatggtgttgccaaaggaagttaacatttgagtcagtgggctgggaaaggcagacccaccattaatcagggtgggcaccatctcatcagctgccagtgcagctagaatataagcaggcagaaaaatgtgaaaaagagagactggcctagcctcccagcctacatattccttccatgctggatgcttcctgccctctaacatcgaacaccaagttcttcagttttggaactcagactggctttcttgctcctcagcctgcagactgcctattgtgggattgatatggtttggccgtgtctcgacccaaatctcaacttgaattatatctccctgaattcccgcgtgctgtgggagggatcctggggcaggtaattgaatcatggggtctggtctttcctgtgctattcttgtgacagtgaataagtctcacgagatctaatgggtttatcaggggtttccgcttttgcttcttcctcattttctcttgcttacaccatgaaagaagtgcctttcaccttctgccatgattctgaggcctccccagccatgtggaactgtaaggccagttaaacctcttttcttccctgtcttgggtatgtctttatcagcagtgtgaaaacagactaatacagggaccttgtgattgggattgtgattgtgtgagttaatacttaataaactcccctttattattatttttatttatttattttgagacggagttttgctcttgttgcctgggctggagtgcagtggcacaatctcggctcaccgcaacctccgcctccctggttcaagtgattctcctgcctcagccttccaagtagctgcaattacaggcatgcgccaccatgcctggctaattttgtattttcagtagagatggggtttctccatgttggtcaggctggtctcgaactcccgacctcaggtgatccacccgcctcggcctcccaaagtgctgggattacaggtgtgagccactgcacccagcctaaattcccctttatatagatgtatatatataatatatatcccattaactctgtctttctagagaaccctgactaatacaaatgtggaaggactagactggcttagtcttcaggcctacatctttctcccgtgctggataattcccacccttgaacatcatactccaagttcttcagctctgggactcagacctgcaaccaccgactgtaggctgcactgtcagcttccctacttttgaggttttgggactcagactggcttccttgctcctcagcttgcagctggccttttgtgggacttcaccttgtgtcgtgtgagtcaatactccttaataaattccccatatatacacatctatcgtattagttatgttcctctagataactctgactaaaggcaaatgtgtaattttactttggagaagcatgacaaacaccacctttgctgagtaatcaaggtgagcatcattgatgcacacttttgttccggggtcaggaaacatcaccacaaaggccatctaggtgctgggtgaacctagaaaatgctgccctactactgctcaccagctgtaggtggagttccttgagagacaatcagggacatgaaaagcttgagtttgctcatctgacactggtggtcctcttgtaagatcctcaaagagcagttcaggatcaaaattctttcctggacagaaccaccagtctccattctttcatttctttctatagtttttaccagtttacttgttgttttgtagctgcccaatgggttcttgcctgctgcctagacagaggggatttatcaacggaggagaattgcaatagggaaagagtaattcacgcacagccggctatgtgggaaacaagagttttattgttaaatgttacttaaatcagtctccctgagaattcggggatcagagtttttcagggaagtttggtgggtagggagccagtgagtcaggagttctgattggccgggttggagatggaaatcacagtgaagtggcctcgttgtctggggtgacatccagagtttttggtctcatggccaaggaaatcaaggatgcagacactccaagggtgaggtttagagcagaaatttaataggagaaagaaagagaacagctctctgctacagagagggatcctggaaaaagggctgctgttttgcaaagcttttataagaaactgatgagggctggtcatctcgtttgcataatgcacaaacttctggtagatccaacccatcctcctaatgcacacgtgggcccttaacttgagttactccatattgctttgttccccttactgcacatgtgtgagggaatggaattttccattgcaggtatgtcttggcaagtcacttgtgcatgctttcttatctgtgtgtctatgggcatgtcttaggcaagctctccccactcccttgcaagctcccttatctgtgtctgcaggctgttcttttgtttaaaataattcagctgaggacccactctaactgcctgcctgaccaggttttttcctttctcctctctcaataggaactcaaagctcttctcttgtgctgagtcagctcctgggtggggaccacaagattaaatgagccagtttatggatcggggtggtaccagctgatccattgggtgcagggtctgcaaaatatctcaagctctgatcttaggctttacaatagtgatgttaaccccaggaggagtttggggaggttgagaatcttgcagcctctgcctgtgactcctaaaccataatttctaatattttaactaacttgttagtcctacaaaggcagtctagtgcctaagcaagaaggaggtttgttttgggaaagggctgtgattgtctttgcttcaaactataaagaataaactaagttcctaccaaagttagttcagcctatgcccaggagtggaaaaggacagcttggaggttagaagcaagatggagcttgttaggtcagatctctttcactttctcagttatgatttagcaatggcagtttcagtttcatctctgttttcttttcttccttgagactttttttaaaaatttattttgagactgagttttgctcttgttgttgcccaggctggagtgcaatggcatgatcttggctcactgcaacctctgccacccaggttcaagcgattctcctgcctcagcctctcgagtagctgggattacaggtgtccaccaccatgcctggctgatttttttgtatttttagtagagacggggcttcaccatgttggccatgtctcgaactcctgacctcaggtgatcgatctgcccacctcaacctcccaaagtgctgggattacaggagtgagccattgtgcctgggcccctagagactttaagagaccacatagtctttagttgctttcatgagaacccagaacattaatgactagtgttattttagaattactattcaatgcagtatgcagaaggcaatgaaatatattgtgccaattataaaggaggaagtagagtaattatatcggggtgaagggacaattttgtaactaaaacttaagagaaccaagcagaaagtaagaatggagatgttaagtcagtaaagtaacatagttggttatgaaattaacacacatattcaatatattccccacatcaaagtaataatctgttaggaaataaactgacaggaaaacaactcatttgtgttaccaaataggcaaaatacaaataaaatacttcaaaactaacttaacaagccaggtacaatataaatttagagaaaatgttgaaacattactggcgtatattaagtaagtattaagttagtgggaaaacatattatttttttcttggtgaggaagactctgtgttgtaaagatgtcagtctccctaaattaatttgtaaattgaaggcaatatcaatgtaaatgccaacagaatttctttgagttctagaaaagctgattttaaaagaaatgggggaggaacagcccacctatatatccagatttataacactacatttattaaagctacttggggttggcacagaaatatacatagagagtaattgatgggacaaacggcccataaatagattggtacacagaaaggaatttggtacatgacaaagggagcactgcaaatcagtgaggaagagagaatgcatttaacaaaaagttgtgtgttctgaccattagagggaaaaatacatgcatgtacacatatatgtgcatgtatacatatatatattcatgcatacatgtatatgtaactaaatttgctactatatttagtaactatgtacatatttatacacatacaatatgctaaattcaactatataagaatgcatatagatgtagatttctacttatctacttgtggtttatattctttcttatatacaattaaatttaagtgtagaaattctaaaagggagcagagtttattttacaaacatggtgttgaagtggagataactttcaaagaaagacagaaaccctgtgcaccacaaagattgatgaatttgggcacagataagtttacaatttctatattcaaaaataaactataaatgaaattaaaagagaaaaatttaaaaccctcatatctgctggactaggtcgtactggatttaaggatagggatgcttcctttcatttacacagttgctcagtatcaacagaactcctggaccttgtatgctgtgttctaggcaattactctagaaatgtcagaggcattcatacctgagcaactccatcttgagatagggctaggaaaaatgaggctggaacttcctgggctgcattccaaggaggttaggtactcctagcctctagatgtttacggttaaggggagaatagattaataatgtttaccaaacagacccaaattcaggaatgtactggatatcccgatatcttgacaacaaaagcattcctaattttgctttaaagacaataatatcgattcttgcaaaatatagtaaggaaaattaatcccttatcacaaatgcttgtaatacagcacatctccccatgattttttgttatcctctatataaacaagcattgtacctagggtgggcgcatttctccttttactttcaggaacagcctactctgtctatggaggagctattctttcaccactttactttcttaacaaacttgctttcgctttgcactgtagactcgccccaaattctttcttgcaggagatccaagagctctctcttggggtttggattgggacccctttctgatagcagaaacattagattatcgattgattgtgttaatcagaattccatattttcaaacctgaattttttccccacatgcaggccaggggaattgactcatgtatcctaaggaagtaagactcactgaaagtcccagaattcatcctttcccttaacagaaaattaactgtgggatatgagggggtaaaaaatcaacaccgtgaaaagagctggctgaagtataaaaaagtggtccaagctacagagctctctgacttatagaaatttttttttggttttatttttttttttggtaactgttttattcagatataattcacccatttaaggtgtaaaattcaatgggttttagcacagtaaaatgattgtgcaaccataatcacaacctactttagaatattttcatcatccccaaaagaaatactgtattcgtcggctattaccctgcattccacccccataccccaccacaaccccagcctcaggcaagcactaatatattgatgatctctatagatttgcctgttctagacatttatataaatataatcaaaagtggtattgtttctggcttatttcacttagcataatgttttcaaggcacatggatgttgcagcatgtaccagtacttcattcctttctatggttagctattccgttgcctggctatatcacattttgtttatccacccgtcaattaatgaacgtgtcagttattcaactttggtcttcttttttgagaatgatttggctattcagagtgccttgcaattccatgtgaatttcaggatcaactttttcacttctgacatagtccactgggattttgctggggattgtggtgattcaggagaccaccctgtcaaatacaatcttcttagcaatatcgggtcttccaaacctagaacacaagatgcctttccacttatgtaggtcttcattaattaccttgagcaaatgttcgtacttttcagagtctaagtgttgtaccgctttctgtaatttactcctaagtaatgtattttattttttgttgctattgcaacttgaattatttttcgtaattttgtttttggatcatccattggaagcatatagaaattcaattgactttttaaatattgatcttgcatctttagaattttcttgttacaagatcatgacatctgcaaatagatattgttttacttcttccttgccagtatgcatgcctttcattttattccttttttttaatgacataattgccttggctagaacctccagtataatgtttaatagaagtggtgagagcagaaatctttgtcttgttcctgatattaggggaaaagcatccagcctttcaccattacgtatgatgctagctcttgttgtttttgtatttgtactgcagagaattttgttggattcccatacatggggaaagagaaataaaatccggttcatggtgtgtgttcaaaatatgacatatatatttccatccagctgtggtgtgtgactattcaataaataatcttaaacttatgttgataattatgaatttttaaataacattagtagaatttaacatttaccaaaattaaaattcaacgttaatgctttccccaaaacaaacaacgaccaaaaaattaaaaacagacattaggtttactccatgatattaaaatacaagttttatttacagtgctatgaaccaaatgagtggtaatcttagaatttatttaaaatatattaacaacatggtattttaaaattatcttgaatagcttaattaacttgtcagtttccttaaaaaaaaaaaaagtaatgctaccttacaactataaagcacttttccatttataagagagtctcataatcattacctcatgttaatctctcaattttgagacaggtaaaatgcatatgcatttgaggaataaggagactgggtttcagagacattgcatatgggtaggaacatagctgtttgctggcgaagcttgtgctaaaaatggacccccctcattcagttttctgaggtctcctgtccactcaaaacttgctcttcttgatgtaatgttttcagaatggtctgtcaatctcatgccacctgtactttccagcacagagagcacaaatgcacaaggttgaattattaaaaaagttaaatcacaggaaatcaaaagaacattcaagtatcacaagaaattaggatgcaaaataaaagctatatttaaatacatgattatgggctgttggcactaactcgtgtcatttttgtcatcaggtgctttactagggtgagttaatgatgtatatacatgagttcaaaacttttctaaatacatattttaggcaaagctatgtcagtctccaggatgggattctatcttgtcaaaagtctatgcaatctataacattccataattcaattaatttcagaatatttaaagggctattcatcatttctagattggtgaaaattcaacatattgtcttgtgcattgagtcttaagatatctacattatattaaagaattctgaggcagaaaaaaaaaacagagagacttttccttgtaaaggtgagatttcatgagttaccgggcctacaaagtaaaaatggtctagtcaatggaaaaggggttaaaagacgatattcatccatgtttagggatttttctctctttctttttcttttcttttcttttcttttcttttttttttttttttttttttttttgacagggtctttttctgttgccccggcagaaatgtagtcagggcccactgcagccttgacctcccaggctcaaggcattctcctgcctcagcctgtagctagaacaacaggcatgcggaccatgcccagctaattttttattttttgtacagatgagggtctcactatgttgcccagctggtctcgaactcctagactcaaatgattttcctgccttggtctcatagaattctgaaattacaggtgtgagccactgcacccggctgggatttttcacatttaggtctaggaaacattttttttttttttttggtggctccaatgcatgtatcaagaatataatgacacaggtttgttttatgggatgacagataattgctctgcaagcatgctgacaatcctataagtatgatttgcagtaagcccccaaacacattttcccatgtgtcttctgtgataacaatagaaggccttcctgctactcatccatgcacacagggcaaattctctcatccacagttgaaataaccagagaatttaggcagcacttggggagcctgcagtataattttgagaagcacccataactgctaatgagctgattgtttccagtgaaatcgtaggcacattgtgaactctgaaaatttgttctttctttctttcttcctctttcttttctttctttctttcttttcttttctttctttcttttctttctttctctttctctctttcttcctttctttctcccttccttccttccttttcttttctttctttctttttctttttctttcttttcttttctttctctcttttcattctctcttttctttctctctctttctttctcttctttctttccctccttccttccttccttccttccttctgtttatgagacagagtctcactctgtcactcaggctggagtgcagtggcacaatttcggatcagcctcgacttcctagactcaggtgatcctcccatctcaacctcctgagtggctagcactacaagcatgcaccaccaagtcctgctcagtttttgtattttttgtagagacggggtttcaccgtgttgcccaggctggtctcaaactcctggcctcaggtaatcctcccatctcagattacaggtgtgagctactgcacctggccccaagaaatgattttcttttgaaaatgtcatcagaatacatgatgagtcaccccagaattgccctctggctctttggtctgcaggttcatcatgtcagtattcacaatagcaaagacatggaatcaacctaaatggcctatcagtggtggactggatggagaaaatgtggtacatatacaccatggaatactacacagccataaaaagaatgaaatcatgttacttgcagcagcatggattcagccgggggacattatcctgagtgaattaatgcaggaacagagaacgaaatacccaaacactgcatgttctcactcacaagtgggagctaaacatgggtactcatggacctaaagatggaaacagcagacactggattagtagaatgaggaggaagagagggtggcaaggtttagaaaagtaactgttgggtccaatgtcactacttgggtgatgggatcatctgtgccacaaacctcagtgtcacacaatatacccaggtaacaaacctgcacatgtactccctgaatctaaaataaaaattgaaattaaaaaacacagcgtatttacatgtttaaagcctttcctgtacgttgctgtattttttttccagaaacttacagcaatttatctcccaccagaaaccgtggggtgtcgtttacttccctcagatgccactaatatttttttccaatggagtggtaaaacattttcacttttagtaagaccacaacaccaaggccaacagggctactgatgtccagttcctaagtttactctctgccctgcatctctcctgtacctttctttcacagcttctctatcaatactatgaactccagtccctgcagaatgcagcagtttcttgaatgaatgctttatgaccttttgttcttcccagcatttgcaggtgctatccccttggtctggcatgttcttatccaccctttgctacttatccttttcttgctccagcttcttgatgcaattgggattttgctttcttgtcttggctgtttcattttatgcgtcgacttgcccggggttaaggtgcgctcctgttttgtcagagaccagttgcgatgatgctgtgaaggtattatgtaggtatgattaacatttacaataatatgctttgacaaaagcagaatgccctctgtgatgtgtgtgggtgtcttagtccacttgaactgctattacaaaaacaccatagactaggaggtttacacaacagacatttgtttctcatagttctagaggctggcagtccaagatcaaggtgtgccagattctgtgtctggtgagggctctcttcctggttcatagatggcagtttcttgctgtgtctacacatggtggaaggagtgagggagctttctacagtctctttcataaaggcactaatcccattcctgtgggctctgccctcatcacttcccaaagccctcacctcctaacatcatcacctggggaattaagatttcaatgtatgaattttgtaggggacacgcacattcattctgtaacagagggcttcattcaatcattgagggctttaaaagcaaaaactgaggattcctcaagaagaaggacttctgcctccagcctgcaacatagaagtcctgcctacacttcaaactttcagattggttctatttaagttactggagaaatctccaaactgctttccacagtgactgaactaatttacattcccaacaacagtgtataagcattcctttttctccatagtgttaccaacatgttattttttcaccttgtaataatactcaatgaataccctttgacttagcaatcccattcctagaaacataggttatgcaaatagtcactgatgggtgcaaagatttaattgtatgttcttccaagttttgtttattcacagtgaagaggtggacagacactgaatatcccaaatggagaattggggtaaaactaaaagtagttgaaagccaatgcaactatttcatgatagtgttccaggaaaactaatgagagagggggtcaccagtgtaatacatgaattaacaaaagaagtcaaaatgattttgtgtatgtaaacatagctgcagatacacagctacagatacagatacagtcatagatataactataaagatgtatgcccaatagataacagtggtgcaattacaagtaatttaattctttctttgcacatgtctgtctgtattaaatatatttttaaatgacaaccagtagtaactgtagtggagaaacctgacaaatactccttcagctgggtgatcaacgtcaaggtcaacagaaataagtgatgttggtgggacgcttctttgctaggatgtgattaataccgtactttacctctgcctttctttaaaaaacctataaccctagcctaaacatgagaaaaccatcagaaaaattgcaactaagggtcattctacaaagaaacctgagctgtactctccaaaactgtcaagatcattgaaaacaaggaaagtctgagaaactgccacagttaaaaggaacctaagaggaaaagatgattaaagatgtagggtaccctgaaagagaccctggaacagaaagagactgttaggcaaaaaggaaggaactctaaataatatacggatgttagttaatgatagtgtaacagtttgggttaattaattgtgacaaatatacgaaacactgtgcagagatgaactttgtgaggggaaggaacttcaccataatgagtctgttttctagagttaaagagctttccagtttcagccccttcattccatcttcctactcttcccccactgcccacaaaggtgcataagggggtggtctcatttgaaattaaaatcgaccccggagtctacaacaggcatcttttataaactttcagtctgaactgtgtgaagttttgtttcccatccccatccataaatagctgtctgtagtaatttctctccattcctgtgcccccttttgaactccaatatcaactagcagttgtaggaatagggcgggagacacttcttgtatcttaattataatttcctataacatatcacagatcaggtgagctggcatctgtccttccttaaccttcttctgggctggggacaaaccaaggcttggctgcatctctgacctcccagctggtgcaagtcccagcccacgatgatgtcacagtgctgtggttatgcatatctgtgatatcaggggtgtttaggcgatgaactgtgtattagtctgttctcaagctgctaataaagacatagccaagactgggtaatttataaaggaaaaaggtttaattgactcacagttccacatgactggggaggcctcaaaatcatggcagaggagcaagggatgtcttacagggtggcaggcaagaagagagaatgagagccaagtggaaggggtttatcccttataaaataatcagatcttgtgagacttatccactaccacagaacagtatgggagaaacttcccccatgattcagttatttcccactgagttcctcccacaacacatgggaattatgggagctacaatgcaagatgagattttggtggggacacagccaaaccatatcaaactgtgatgcttgaaattaggaaaatgtaccctctgatgcatctcgaattttggctatgaatattttcacagttgctgaagcacatggctgaaacgctttcccaaagagttgtgccagtttctactccaaacagcattagaggtaggagcattttttcttaaattgcatttaggaacagataggaggggtagaagttcgaggagagggcaaatagctgtcaagtaatggaaagaatattggagcatgtttcaggtgaatgaactttagtccctgggctctctgcaccatgatggtatcttcattcaggccagtgactgtgaggttctgtgttttcttttacaaagaggaatctggacctgctgcctccaaagttgcctctggttctgaaattttatggctacgattctatcacaaaattcacaacgatgctggagtggttctgctgtgaccaaagggggagttaaatcatcgtaaacccaaaaggatgcataatggaattatcataggatttgaattatgtacttattatttgccatgtaagggcatgcttttgggagacatgactggatccaaaaatgtgaaacgtgttgggtttcgttgggtagtcctgactgatttattcattcaattaaaaatgggtttagcatcctgtctgtatttggagtcgatattaccttgaaggaacagaagagagaagaaaaaagaagaaaaagacgacaaatgaaggggaaggaaaggaggagagattgaagcatcgtgtggaaatggggataagaggctgtgcgtcaaggaatgagggtagcctctagaaattggaatagaccaaagaataatctcccctagagcctccaaaaggaatgatatcccgccaataccttgattttagcccagtgatagcatgtcagaatcttgacctcaagactgtaagataataaatttgtgttgttttaagctggcaaatgcatggtgcttttctacagaagcagtaaaatactaatagagtttagctctctgatgaatggtttctgtccccttatgagaaaactcccatttctgtaaaggaacaaaactctagaaatcagtcttgatgaggactggccgtttctacttatccagatgaatggattcgtgcagttctggtcaggacggatcaccagggaaatttcctggctccacgccctgttcagaattccttggagttagcaggtacaagaatttactgtccttgatggtaccttgtgttgcatcggatttcttaattaaagacgagatattttaatacaaaaatgatacgttaaagtgacgacatcgtttagccttaatacgtgatcaaatgtggagcatgttttttcttaaatggttaaaaattctgttaaaattttcctagatgttcttttatacacagcctcagctacaaatttatgtatttctaaagcaaaggaaggtttctctttagattaaggtcatttctcttctcttttccttttcttctcctacaatgcacatacgcatatattggtaatttgtatcatacaagagtatgaattgagaatgtttaaatggtaattttcatacaataaaaaaagaagaaataagactgtgaataatcaactggacacaataatagaaaacagtagttgctaagctgtagtcgccagaccagaaggttgatgatctgggaatttgtttaaaaggcacatttttagctgaggcaggcgggttgctggaggccaggcatttgagagcagcctgggcaacagagggtgactgcatctctacaaaaaatttttaaaagttagctgggcatggtggtgaaacctataattccagctacctgggaggttgaggttggaggatctcctgagcccaggacttggaggctgcaataagctatgattgcgccactacgctttagcctgggcgacagagtgagaccctgtctctaaataataaaacaaaggcacgttttcaaatctctgcccagacttccgcagagaagctatagaattcagacatagaatgaatcttggctataaggcagaaccatgtgattgcttcaaagatgaggtcaaatactgcatccatgcaacggcagagatctaagggtttttaaggtttccacccactcccacctccaaaattcctattgtactagagttatcctttttatttggcctttaagaataaaaaattatatatatatatatatgtgtgtgtgtgtatgtgtatatatattacacacatttatgtatatattttatacacacacacatatgtatatcttactattggaagtgtaattcttgaaagagagcttgtagaaaatgccaaatttcaggatgcaaactggacctattatggaatctgcatttgagttttccaggtgactcatatacccattaaaaatggagaaacatggcatgtaatcccaacactttgagaggctaaggtgggcagaccacctgaggtgaggagtttgagatcagcctggccaatatggcaaaaccctgtctctactaaaaatacaaaaattagctgggcatggtggcgagtgcctgtagtcccagctactcgggaggctgaggcaggagaatcgcttgaatgccggaggtggagattgcagtaagctgggatcgtgccactgcactccagcctgggtgacagagtgagactccatctgaaaagaaaaaagaaaaatgagaaacaatgctttaaaagactctactccttgaaatgttgaagctacttcctcatcctaagatatgtgtcttcttatttatttttattttattttgaagaactgcaaagagaggaaaatctttaaagtgatcattatcactacctaatttcttgtgttttaaaaatcaataatttactattgtattagtttactttttttttaaagcagtagggagaaagccccattttccctgttttatatctacaaatatgatacagaatgaaaaaaaatcattttttgacatttgaaaacatttttcctgatgttaattattaaattaaaggattccagctggtagtttcactggtgatcatttttccttttttccaaattgtcgaagaataaacctacccaagtggataccttgatttgatacctggggttagcaaagtttcaagtcccatcacaatgacaggagagtatttattctcactgttggtggcattatactcattcatacatttaccatgccttccagatttttcctcttcctgtaaatcaatcagggtaatgtcatcagagcagaactcctagaaaacgtatgtgtgtgtatatatgtacatatgtgtgtgtgtatatatgtatatatgtgtgtatatatgtgtgtttatatatatatatatatatgtatgtataatatatttgttacagagatttcactttaacaacttaaggaactgtttgagctgcctacctaagcctgttgtctttgcaaatttaatgctggagccaaacgtctatagggcaggtggttaggaagggaagatgcccgtgaagtgggagagattgggaacagtctggagtccacaagtgggacttgcagccatacaaagatggtgctgctacggtctgaatatttccatttcctcaaaatttacatgttgaaatcctcatccccatagtgatggtattagaaggtggggcatttgccaagtgatgaggtcatgcaggtggagcctcatcaattggatgagtgtccttgtaaaagagaccccagagtgctcccttactcctttgaccagatgaggacacaagaagaaggagccatctatggaccagtgggtcctcatcagacacagaatctatcagtgctttgatcctcaacacccagcctccagacctgtgaaaattaagtttctgttgtttccaagctccaagtccatagtattttatttaacatcccaaatggactaagacaaatggactaaaacatatgtcttatcgttgcctctgaccttggtaatgaagaactgcagaactgcagaatccagaagcctgccttacagagctaaacacacacacctggcttaggaatcagagatgccaaaggaggatccaggaacaggtggggcagttgcagacctggctgctgcttcctgctaacaaggtgattcagcacatctgtgactaagtgtgtgacctgcaaagtggctgctgctttctttctacattcctcgtcctccaagaatctcccttgcggaaattcatgcagaaaggggaaatatgtaagaaagagagttcttggaaatttaattcagcaaagccaaattaacacattacaaagccactgacgtctatccactcctcgctgacttctccgagtttatacagcatttaatgacctggatctcaccatttcatatgggtaaattgaaacttaaccaaacccaaactttcttgctctgactcaagtgacctttcagaatccaaaccatgtaaaaatgcccaaataaatgtcctatgataggaccatgttttcccaacttatgtgtccagttctgatccttaaagagacttcactaaaactcatgtctcctttaaatcctaagatagctacagctggatgattttaggttataacttttggattgaaattatagaatgatggaaggggcaatatgaacatttatatgcaaaagggttcaaggcagaaaatgactgggtaatcagaattcaactcctagttcttcatttggtccatttgaaaaatcgggcctctttgtcctactctccagggaaatacctgatacacatccagtttcaaagaggagatgttaagaaatgccttcctctaaattcactagatgtattcatttctggacactgaccttattcctctatcagaccatttaacattttccctttaagtacatgtttatctttttcctctgaaaagaaaaaaaaaaagctcttttctttggttagtaagtagctggagggtggataattactctgtatgtatttagtcgcaagtatcattagaattctgaattaaaaataagattaatgatttaatttcaatcttgtcaggatgacccatttaaaaaatactgatgtgatataatgctataaaagatttaagcataatttattgataaaaccattacaactggaatgagagagctatttgtctacataatggttcctgaaatcacagatagtactttcccattattccactgcaacatttataattcctttttagatttaccattttttcaaacaaccacatatggtacttattatatgccaggaagtgttcaaagggtcttacaaatactaactcatttagtcctcacaatgacttaacaaagcagcactattgccttccctacattgtgcataagaaaatggcagcatgggccgggtactgtggctcacccctgtaaccccagaactttgggacgctgaggtgggtggatcatgaggtcaagagatagagaccatcctggccaacatggtgaaatcccgtctctactaaaaatacaaaaattagctgggtgtggtggcacgcacttgtagtcccagctattcgggaggctgaggcaggagaatcgcttgaacccgggaggcggaggttgcagtgagccgagatcacaccactgcactccatccagcctggcaacagagcgagacttcttctaaaaaataaaaataaaataaaataaaaatggcagcatgacaagcatgggtaacctgcccaattgaacacagcagatgagttttggagccatgatacaaaccagagtctggctgcctaaccatggctccatattgtttctgcattgtagataaaccagtgagaacttggactgatggcagtagttaatgcacctttgcatttgagaaagtagctgggtggcaagattattggtgtgaaaaattctcaaatatataaaattcatatttctcataaatcaaacattgcataaattttctcttccttgggatttatataaatttaggtgtagaaagttaatgtagaagttgcacttttggctaagagggggtaaacaggcaattaccttcccatcagaaagaaacaaagacgatatgtgaaactatggtttttaagacactggatatcaatcaaaagataagtgattccagaaagagagctaataaatgaggtgaatactttttattgcatagctcccacattgagagagattccaggcaatggtatgaggaggggaacttacacagaaccagtggactgtctgatttgaagtgatgaacctggtagtttagagagaacaaggcagctagaatttgaagcacagggttacaggagagaagagagatgtacagagaactgccccctcaaaaaaaaaaaaaaaaaaaaaaaaaaaaaaaaaaaaaagcctgcatgcagagtgtccctgttgagtatttaaccaattgctgatgcagcatgcatatgagaaaattacacaaggatggagatataaacatccaaaagaatcagcacactgttcaaggttcacaaagggctgtaaatgatgcctgttttcaccagccagaaggaaaaaaaattccctaaatacatgagacactgtataaagttttgaggttggtcttgctttagtaaggaagaaaagattagcaacaacctgagttctaatcaggtcctgcctaacaaacctgaaaagcaagactctaagagatcaatctcattcaaaattccttaactcaagcgcagaataaaacctaagaaattttagaggaataaaaaaaaaacaaaaacccaacccccaaagtggtaaaattcactgtctctggcattcaaagcttacagcatttgggcctgtcgcagtgttggagaccagcctggccaacatggtgaaaccccgtctctactaaaaatacaaaatttagctgggtgtggtggctggcgcctgtagtcccaactactcaggaggttgagggaagagaatcgcttgaagccgggggaggcagaggttgcagtcagccaagatcgcactactgcacttcagcctgggtgaaaagcaagactctgtctcaaaaaaaagaagaaggaaaaaaagcttactgcatttgaatgaatagcaatggaaactgtctaaaatgaaacacacagaagaaaaaaaaagtaaaaacgaaaagaacatcagtgagctgtgggacaacttcaagtatcctaatgggtgagtaattggaatactcaaaggaaaagaaaggggagcagacacacacacacacacccacacacacacacacacacacacacacacacacacacttcaagaaataatggccagaaattttcaaaaaatttgaaaaagctatcagcctattgacacagtaatctcaaccaactctaagcacaaggaagctgagaaaaactttgccaaggcacatcataatcaaactgctcaaaactagtgataaagacaaaatataactattagccagaggaaaaaaacacattatgtatagaggagcaaagataagaataactttggatttcttgtcactaataatgtaagcaaaaagagaagaaacatacttacggtacttctaataagtatctatatttttgctggttatagaagtctatacttattacaggtgataagtctatacttaggctgcgtgcagtggctcatgcctgtaatcccagcactttgggaggccgaggtgggtgaatcactaggtcaggagatggagaccatcccggctaacacagtgaaaccccgtctctactaaaacagaaaatacaaaaaattagtcgggtgtggtggtgggtgcctgtagtcccagctactcgggaggctgaggcagaatggtgtgaacctgggaggcagagcttgcagtgagcggagattgtgtcactgcactccagtttgggagtcagagagaaactctgtctcaaaaatcaatcaatcaatcaatcaatctatacttattacagataataagtacagtcttctatacccagcaaaaatatcttcaaatcaaacaacagtgaagaaaagacacttctaaacatttaaaaccagaaataattcatgatcagcagacatgcagtacaatgcatgtccaaagaattcctttaggcagagggattgatattagatggaaatttcaattgtacacaaaagcaggagaagcagcagaaatggtagataattgataaaactataagacttttatctttttatgtgttttaaacagataattgattaaagaaatataggaatgtattgtgaggtttataagatatttagaagtaaaatgcattacaacgatagcatattctgggaaggaaaagtggatgtatactatcatataacattgcacaaaaggcagcacaaggaaagaaaacaacagactgatattcctcataaccatagagacaacatttctaaatgcatttttagcaaattgtagcaaaactacataaaaagattattaaatcatgaccaggagggataattctaaaaatataaggttgttttaacattcaaaccaaccaatgccatattaacattaaacaaaattgccttaatatttgaataaaaataattattgaaattcagcatccactcctgatttttaaaaattgttatcaaaattagaaaaggaatcaattttctcaacttgataaagagcatctacataaaacctgcaactaataacataatggtgaattattctttccctccacccacaagttggaaacaagacaagtatgtctgctctcacaacttctactcaccattgtactggagattgtagccagtaaaataaggaaaacgaaaattctccagattggaaaggaagagtcaaaactgtcttcctttgcagatgacatggtcatccatgtagaagatctgactgaatataccaaacagttactataattattaagtgcatttagaaacatttcaagataaagatcaatagacaaaaaataaattgtatttctatatcctagcaatgagcatttgaaaactgaaattaagaaaacaaaacaacaaccacatcaacaatatgaaattcttagggataattcctacagaagatgttcaagaaagtcttgtgcactgaaaactacaaaactttactgagaagttaaagaaaaccttaatcaatggggagatatactttgctcatggttgggaagactcagtgtggtcaagatattggttctgcccacattgattgatagattcaacacaatcccagtcaaaatcccagctaatttttttctcaaaattgacaagcttattctacaatttatttgtaaattttaaaaacctggaatagctacaaaaaataaaaaaagaacaaatttgaaggtctaacactacttaatttcaagatatacataagctatagtaatcaagacatcacaatattgccatgaagatggacaaacagatcaaggaaacagagtagatacttgagaaacagacccacaaatacacaaaaacttcacttctacacataaatacacacacacacacacacgcacacaaagagttaactggacatttgcaggacacaaggagcaggtatttggaatatatgccacgagcctattttttaggcttctgtgcagatgaaataatcaatactgtttccaactaagcctatatttcttctcaacaaagaatataatgtagccatttctagctgatcatagattgacattggacaaatcaaagttggcatctctgatgttgaccaactcatgtctcatcttagaggtgataaagtcaaggcacaggtagttgatagtaattagaagaatattcaggacaagaagtcgatagcttaattccaatccagagtcctctacatgacaggccagaagatagactgaatgggtatataagactatgggggatgggtgcagagtatgatgcaggcaaaaataaaaagctaaattgtctaaaattagacttgtaccacagaatactttgattcgatccattttcaaatttgatgacctatgatatttatgatctaatatattgaacatgttaaataagaaattctaattatattttagcagaaagtatatatcaagcaaattgtattcccttttctgttttattgatttatcatatcatctaaatgattttccaattctctaaaaacataaatttaagattaagttgtgtctgtatacatatttttccttaatagactccctgtcaataatctattttcaaatgatgaatcttggtaaatatacttaaactctttttgtaaaaaaatttttgagacactcttgcttcgttgcccaggctgaagtacagtggcatgatctcagctagctgaaacctccacctcccagattcaagcgattctcattcctcaacctcctgagtagctgggactacaggcacgtgccatcatgccctcctaatttctgtatttttagtagagatggggtttcaccatgttggccaggctggtctcgaactcctgacctcaagtgatcctcctgcctcggcctcccaaagtgctgggattacaggcatgagccaccgcacctgaccttgaactcatttttaagagaaattaagatatacagtgaatatatgtcatgacagtcctatatgcactcataattcattaacaatttatatccatttataatattttcataataaaattcaattttaattattttttgtaatagaaaattgggaagataggaattagggcagagtatacatcctaacttttttagggtctgattgcttaaaaccctaaatatttgcctctttcttatgaatcttgctaaataaaaaattgggagttttgatcagtgaagatttttaccatacttacacattgctaaccattggcaacagaaaatttatcagaaagctttttatgttgcattgataggaacagttaaaaatatgaattaaaatactttcattgcaaggagatttaaaaaatgatttactaacaatctgttatcaattatacccatgataaactcataggtgcttttaagagtatattttacagcaggaaacatacttcagacagctcttactcatttaaaaattcttatgaactatccaggctagacataggggctacgtggagacagaatatttggttaaatatgtgcttttttaatgacagttcgggtcaggtcattacttggaacaacaatacatgtaaattggcaacagggacttaggtgagacagccgttccctcctcctgagattaattgaacataaaattaccttacctgagagtgaaatatattatcagcaagccaaataattctccatcaggttttcatttgtttataaaaacagtaataaagcatttcactctaaaagcctaatactcactatgctcaattatagaggagataatttaacaacccatgtcatcagtaatgaaaaaatcaaggtagctttgtgcatttttgcaacgcaaatactgagcgtgttggtctgtgtatttccaacagtgtacaaaagttacattcaagagagtatcagtggtttgaaaactgcttggattagctgaaatctccaaaagacaaaggaatacccacaagtcaactgcagtattggccctaaatggtcccaccatttctgattcttttgatcaaaaaagcaaccttttataatgaaaatgcatgaggagcctcccctctaaaaatattgttttcatttgcattcctttcactgtgagtaaagttcaacctcttttcatatgcttaaggtcatttgttttttctaatttgattttttttaacttttattttatgttcaggggtacaagttcagatttattgtatgggtaaacttatgtcatgggagttcgtggtacagattatttcataccccaggcattaagccaaatacccattagctatttttcccgatcctttccctcctccttccctccaccttctgaaaggccccagtgtgtgttgttcctctctatgtgtccatgtgttctcatcattcagctcccacttataagtgagaacatgcggtatttgattttctatccctgtgttagtttgttaaaaggtctttttgttagttatttatttgtgctttttgcctgttcttaaaaacatgtctctttcctccttgttttttcaaataagtttctatatatcgagaatattagccacttatccattataaaccctgcaaatatctccacattatttgtcactagctttttacttaacttatgacattttatgcaatgtagagtttttaaaaatgtactcacatttatcagtcttcttttattgatatgggttctgtgtcataaaaagccattttcctccatccaggtcatagaaaaaaatttccagctttcctgctagttcttttgtagttcattttttaaaaaaactttaaaactttagatatatgttccattggggattcttttttgatatggtgtgatgggtggatctaaatttaccttttcttaaatggctgcacacatttgtcttaataccattttttaaaaagtccactattgtccaaatgatgtgaggtctaacttcatcctatactacatttctatatatccttggctctatttctttactttctattctattccattactttctttattcttatgccagtttgataatcttttcttttttttctttcttttttttttttttttttgagacagagtctccctctgtcacccaggctggagtgtagtggcacgatctgcaacctccacctcctgggttcaagcaattctcacgcctcagccttgagagtagcttgtgccaccacgccctgctaattttcgtatttttagtagagatgggatttcaccattttgcccaggctggtctcaaactcctgacctaaagcaatccacctgcctcatcctcccaaagtgctcggattacaggagtgagccaccacaccggccaatagtcttgatagtgaatttgttgcatattttaatatccagtgtgatgaggctgccctcatgagtcttcatctttttaaccatcctcacgtaataaaatacgatgtagttagtccttggtgaagcattacccagacactcagcaacttcaaaacttggtagacctggaggtgcgtggtggtttggagtgtcagtgggcaactccaagccaccaagcctttctaaatgtggaatgggatgagggagagacagcgagagagaaagagaatgagagaccaagaaagagggagagacagagaaagagagagagagcgagagagaaagagaatgagagaccaagaaagagggagagacagagagagagagagagagagagagagaaaggagatgattactcccgtggaaaaattttgtaagtgccaatcaaatatcacccaaagtccgtttggagatacacagtaaatgaaatgttttaagtgtctcagttttcaaactctcacttgggaaatgttactttggaaatacctagcatttctttctatgacttctgcagctgtgatattccttctgcaataagtattcaaggaagaagtaaggttgcctgttgcctacagttttactccgtagtgaaaactgtgggagagattttgagtgtcacataatttagatttccttttcaaatattagacatgctttgtgtttggagaagccatcattcaaagaatagacatgcaaaggtaaaccactgaagctgtgagcacctgaaattctggccccaagcagatgcttccctgatcttagatgttgttctgaagaaactggggaactgggactctacagtgttgtttaccagagattgttgtaggtcagtgactgcatttggactttgtagaaataccgttgtctcagtgttgcagaatattaggacaaaatggagagtttcactcttcttttttttttttttttttccggctgtgagtgagaattcctaccagctagaatagcatggattgcctttcctgttttctttttacagtagctttgtttgcaattgctttaacttttccccaatttcttggcattttgtaaacaggatttctagttcaagaccactttcttcagttatgatggtaaagtgtggtctttttaatgctcggtcatggtgatggtgatggtggtggagaagataggattgaagtatcttgttactctttccttccagcagaatcttaattttcccttttttccttctttctctcgatataactatttctctaatgagactattctgattgttattccccaggcaatgtcacttctaggctgctaacctgagacctactcacattgaaggctctttcttccacctggttttcttagacaccaaggctcatgctccgtctttaacactcaatgtgagactttatgggatgttttgttctgtttttcttctgggtcctacactttctttcctttttctcaaggctgaccataacggagagatgcaagttggaatggttgttgtctttcactaggcatgggtcatacatgattttattttcactcatttttatttttattttgtcttttttgaaaagatgcacggagagattttcattcaggcatctactcttatcatccagaaatggaaggtatctgcaatctctgtttatttctatcaccatgcagattataaagcatattgtatagtttcatgtttataatttttataatgtaaatgtttatataaaatgtgtataattcatacactttatatcaaatatgatgtttataattttcattgtaatgcttataagtttactgtggattttctgtctatattatatgatgaagaactttagacagggtagaactaacacactttcaaataccaaattctttgatatcaaagttgcaaaactttgatatcaaaaattgataacaaataataaataaaattgtcctttaagagtcaacaataaaaatctttcattttagtacaaactgaacctggtacatgacaacgtttggattaataaaattccatttttgattcaaacctgaagtaaaagaatgaatgaattggattagcatgaacttcttagcacacagtagcatgatttagctggaaaagctgagcaatatattaagaaataaaatcagaatgatttataatcacccactctttagaaaaagtgtgaaagaaagaaacatttaaaaataagtaaaattgaagtggcttcaaagaaagaattaattccatagcgatgacagtgaagtagatcataaaatgcataatatgagaagtgcagaataactatttttcaagtgtaatactctaatagtatttgtgttccaatattttgacaactgctaaaaatggcagctgcctgtaaaactagaataagtgttgtcataatacattgctgaaattttatatttattttttcacaaattagaagtaagttttggtgttttctgaacagactgccaaatgttcaccagccttacaattcaccatacgttacatgaattaagaaaagcacagctatgctgcagagtgtatttgtcttcaaaacagccactttaaccaatgtagttctctgtctttatgcgcctggctcagcacatgaataaatacacaaatgagtggtcctgccacttcttaagcttcatgatgctttctactctcatcttctttcttctcttaaacaggattcaggtatatctgaattctgaggcatattcatagtctgaaccctaggcattttttttttttttttgagacaaaatcttgctctgtcacccaggccgtagtgcagttgtgtgatctcagctcactgcaacctttgcttcctaggttcaagtgattctcctgcctctgccacccaagtagcttggactacaggtgcaggacaccacgcccagctaatttttgtatttttagtagagatggggttttaccatgttggccagactggtctcaaactccttggcttcccaaagtgctgggattataggtgtgagcccccatgcctggcctctaccctaggcattctataataaaatcaataatacttaaatacatgcacattcataataaatatattcagcacagccattctgtgttaccttgacaaataacaagtacttagtattcaagaaaaaaagagaagtgtctattaatacatctctttcataattttacatagaactcatcagctataaaacacagttgaatggacaaacccctaaccaatctcttagatgcaattttgtgtgagaattcctgctttgtagaagacagtcaaattcacagttgcatgcccatggcaacttcctcaaaaaagtactcaggatttttagggaaataaatatgacagatgcagacggtggagaaatggagaaaccaccaccatttactcgtagctgcaactatcctcgttttgcattaggtagtttatatgaaacatctttgtaacttttcagtgtttttagaaattattcctttctaagatatctctcccagagagaggctggagaatttattcttccataccaacctccttcaagtgcatctacctcaccaaagtgattcctatatggcacatcaaatatttcttagtttaagcaaactaaagttcactatacttaaggtcattttatactttgaaaggctcctggatttattggccgtgctcagctatgatatagaaccatagttgttgggttttttttttggagggggcaggtatcaataaatatttttgggaggaaaatggaactgccatgtgaatcgatgatttgaaataatatcaagtctactgttcaaaagatagggaagaagctattttttctccaaatagtaatatttcccagggagtcaggattcaaaggtaaactagatcatttaattcagtgattctctttgctcagagtgggagagtggggtcacaagaactcccttgcagaggaaactggtgccatgagggtgagggggtgttgccagtaaatggagtccttctattcaatttttaattgaaaaataaaaattatatataatatatatttatggtatacaatgtgatttttgatgtatgtgtacattgcaaagcagttaaatcaaaataacatatcgatgaactcacctacttattatttatttggtgggttgataaaagaaaaacttcagccgaattacatttaaaggagtttaattgagcaatgaacaattcgcgaatcgggcagtccccagaatcacagcagattcagagagactccgggttgcctcatgatctgaatgaatttatagacaaaaaggtaaagtgacgtacaggaattggaagtgaggtacagaaacagtgagattggttacagctcagtgtttgcctgatttgaacgcagtttgaacattgagcagtctatgagtggttgaagtatggcagctgggattggccaacactcagctattgttacaggcgcatattattaagttaggttttcaattttgtctgactattaagctaagttacagttcatccacaaggactcaaatatagaagtacggagtccttctcaggccatatttagtttgctttaacagggtgaacacttaaaagtctactctcttagcagttttcaagcatacattattattaactgtgtgtttcttgaatttattacttcttcctaactgaaattttgtattctttgaccaacatctcctcagtgcctgatcacttacctgtggaatctaaaaaagtcaaactcttaaaagcagagagtagaatgatggtccttctatatttgcttctgtatttcctgtggaacaaacgatattctggttttcaggataaaccaattcctttcctatatccacatccttctccccttctttgttgtttctttccctactttcccacctctttccaatgccctctccattccttgccccagtcagtgtcatctttttgttgaaactttcttaacctgctccaggaatggctagaggcatcctcctttttgtccacatgctctgtccttgttctgtgaatggtgttcactgcattccatttcgtgctactcttagatctgtatcattctgggctgagggctccttgacgagggagactctacatcgcttacctttgtagcaatatggcggccgagcaggggtcagtgcgtgtcttctgtataggcagatggtaaacatttttggctttgtagaccataaggtttctgttacaactactcagctgtgctgttgtcgcaagcccagccatgatcaatatgtaaaagaatgggtttacagtagctatctttacaaacacaagtggagggctggatttagtttcctgacctggtttcatagagtccagtgggatctaataaatggtcatgagagggatgacttaaaaatgcacacattcttcaaaagttaaagcattcaacatgttttaatcaagtataaaaaactaaatagaaattaagcactaaacataaatatacatatgtgtatatgttagaaatacatagttctgtagtaagacttaatacaaagaaggcaagaaagtgatgaatacaagatttaggataacagtttctctgggcagaggaatgcagggagatggaatagaggaaccaaacagcacaaatctgttatttttaaaattgtatttttgtgtgggtgcctattatattattataaacacagtaacaaataaataggtcattcaaggactaatgatgagagtattcatgagtcaagaattatgtttaatatattttttaggtcaaagccataaaagaagttcttatagttatccccatccttatatatattcttaaccttcccattgatcaagattcttcaaagatggcaatattactttgatgtcttcaacacattctcagtgtctcagctggtaattgttgaggccagagttttaagcagattcaaaatgctttaggtgttcttttaccaggattgtactcctagtggatgattagaattattagaatcgcgtcctgctgtgattctcagagcaccggcttcagaagtgggcaggtgctctacgaggaagctgggcttggaaacccagtgtagcctagtgggtaagcctatagccttcaaagccagactctgtggcttcagatttccactctgcttcttactccctgtgttaatgtgggcaaccgctgcttttcctcctctgtaagatggaacaattgtagcatatacttcataggggtgtggtgggcatgaaatttgctagtagaggagatgtttccagaaaagagttgacacatagtggctgctgattaaatgttatctcttgttagtatgattatcaaacaatttcggttcctgttgtcatttaataagaattctggaaggagacatgagcctattttttgcttagggattcagaaatattagggacacatttggtgccactctctttggtctctgtctccatgatggtcacgatatgacagctgtagctccagtgatttcgtctccattccacaatgggagaaggaaaaatgggagaatacaagggataagccagataagttcatatcatagcaaggcacacttgtccaagccaaggcaatggtttccttttaaagaccattgggtagatccatgtcacacagagcatcacccagctttatggcaggatggacgatgaagtcctattctagttggttatattctaactcagaacaaagcaagaggactactcagcctgaaggagacgacaatgaacattgggcaggcaacttgtaaaatgccgaaaactgccactccttcctaaccatgctcattctattctgtccagcctagcaccaaggtaaagcagaagagaaatcgagctttgtctctttgtcaacagtgaaaagtgtaacttctacagcaagcaacaggtggtgttcttctgcagcaactgtaacattataaacacttttctgttgtcattttagcatttttgtgtggtggtcaacttgttctggatctgaactttcttgacactacaattatattctgggcctctcttttgtagtttcccttgagggcttgttagataatctggatatattatttgaaaattattgagtaagagatcaccccgatccttagactcgttgtgatttttcgtacaaaatttcattttttgaaaatacttgttctgcctgagtatttttttcatggagaatctcgagtaatgcaatgtatctatatctacctatatctatatatctcaagtgggcacattcaaaattccaccttctgtgcctataaggaactcctcatagatagtcagatagtttgactcatgcccacccccaaaatattagccccaattaatactttcatcttgatcagaattatgtcttgaatattagatatctactaaaaatcaggagtgaatcatttaatccgtatctttttaaaatcagcttacatgcgacttacttttgaacttttaagttttacttaatgttaaaattagtaagctgttcaagtagttcaaaactcaaaataaacattttgtgttgtgacatttcatactaacatttcatcagttgttttcaggtaatcatatattagattattagatttctgtatattcttctggtgtttccttcatgcaaatatgaaaatgaatatgtaattctatttaaccatctttccaacacagaagtcagcgttctatatggattattttgtaccatttttcacctaatatattatagaaagtctttatatatttagaacaattcaatttgatagtttgcaaactattttactattcaagttctattttgcaaaagatcatctaccttgctctccaacttccctggtattctctctctctcagaaatttactttgctcttctcttacctcaaataggtgctattactcttaaaaacatacaaaacaaaactagggtatacattgcctctcactactttcagcgtgttttcttagagataaaccttcaaaatctccataatcacaaaggccaatctttaacatcacctgatagtatgttcagatccaaagtatgcctaaaaaacaaaaacaatataatttaaagctctttgcatatcaaagaatgataaaccaaaatttgtgtctgtagcccccaagatctgaaatcaaccacttcaggaatgtgcaagtgattttccgtgtatttttcctttttaatgacctgggaaggtggattttcttctacagactcggtacagaattggaagaagcaaagtttattagtgagccataaggtaggtattgattgttccggaaagtttaagggagctggaattcgtgactgacgtttataaaatcatggcatatggaaacacttatatatttttattgagctaatttcagaataccacaaccaggacacattcctggaagtcagaaagtcatagttttaggacaaatgccacaaccattctttacacaccagataggaaggatgtagacctcgtttctggaaagggctataatagatagagagtataagtaggtataaaagtatttcaatatatttaggtgatgagtctacaaagaaaacagaaaagactagagatgactgatttacatttctacaattggacaagacattgtgttgggcatttaaaggaagagtctttatgcagagatcaaacatggagcaccacatggcctgtgtagttggtctgactcagtactgcctaggctaggctcttatctgaggtgcagatctccccgtgagatctctccgtctcaatcactgaactgggatcttcagctttgcccagtgtcttcatagtagcttgaagctgagctcatcttaggatatggttaagcttgtggctccaagtaagaatggctgaacgaaggttagggggtgatgaatgcaatgtggttggagaaggaaatgtttatgagaatgtacagctaccctagtcatggattcatccccaagaatagttttgggggataagatgatggaaggtgaagtaaataattcattggggatgagatgatggaaatcagtgtaaatggtttattgaaataagataatagaagaagttgatagaaatagtttactggggacaggatgatgaaggttagtataaatatttattggatataggatgaaggagttggtgtaaacattttactgtgaataggatggaaaaagttgatatagtttattgggggatagggtgatggatatggtgtaaatatttattgtgaacagtgaaggaagttggtgtaaatattttataagagataggatgatggatattgatatggtttattgggaataggatgatggaaatggtgtaaatatttcttgagaaaggatgatggaagctgatgtgaatagtttattggggggtcagatgtcagaggttggtgtagtttattaagggtaggatgatgaacgctggtgtgaatagtctattggaagtagcatgatggaagttgacctcaactctaattgaattgtgtattaaccttcatgatctcatctcagaagtcatattcctctggaatgaagaccacgttaaatgggcgtgaatgctcggtgtgtgctggcttctgtcccagataaatgtgacctttaatttttatcttttatctgatccatttttatgcatattttctggtagtctgtttagttgtgttactacatatttaatatgctggactgtttattgtcattaaaaggaatgatacacatgatgttgtaagctttacattcacatgtgtctctgaaaccaaacacaggctgtgagccaaaaggcacttaatggataaatggatgggttgatgttttagaaatgcagctttcactgaagtgagagaaggtaagaacatatgctgatatgccaacaatcagctgatttaaagattcacagacttatcggcattctcacaagtcttgcagtcaagaaatctacttcgttttgtttaaccccgggatttccaaactcatttgactccagattttttttccagtaatattgttggaaaacctttctgaacaacccatatgcatttgtacataccctgatttttattgggtagtttacacatgaggtcctacttatatgagcgacaaaaacttatttttaaaaagtactcagaaaaagtataaatactagatatttgtgcatgaagtgaattggcattcagaaaccttttctagatttacctcaacttcactttttctaacaattgaaatagaatatgctttaggaatcttttcagttgactttaataaatactatctcaaggtatttatagatcaaaattttagaatagtcttggatttattttggtaatgaaagaaaaagcaaaacaacatacctcttaaaaggtttaggctaagcatagtttatggcaaaatatgagttcttgaccttttattttaaccagaagaaattgttgggttccttgtggacaagttcttttgggttcagccctgtctgtgctcaggaaagggtaagaccatgcatattgtcaaagaagtggctgtcttatggaaaagttggggacagcagggtgtagcaagtaataagaaaaataagatatgcacaggaataattgtaaaaatatctgttatacaaacatgaccttggatgtgtccaatataaatgcaactgctagacctctattagtgtattcctactccccaaagaagttatgggaattacgttaaatttaaaagcaggaaaagtttgaaagttgattgacatcatcctcttaatctaagacctgccatttttgttaaattcttgttaagtcccagaggcttgttttagaaaataatctactctaccagcctctctgaatgatagtcctgcaaagacttactccatctactattttttcttcacttcgtgaagctaactcatggattcctgtgcgatatgaattgtgctttagtgcaggagcactggattacagatgaaatgacgtggattacggtgcctggattggcactcactcattcatacttaacctgtctggacctcaataacaacatccgcaaataactaaagccataatcacccatggtcattgttcattatacgaaatgccaaaatgcaataaattatgtgaaaacattgaagttatgatgtcatgcacacattgtaaattaaataccctttctattgaccatatctgccttcatcaaccacttgaaactgatcattagtcaaaattgatttcctttgccatttgcccacaggctttggttgggaatacctgtccttagataccttttggaggcacaggtggcctagcagcttcctgtgaaaggaaaatttacgtgccttcagattgagaattcgatctgcctctatgatagttccttttcatttttatttaatttgtaaaattaagatacatttaacaattaccagatacttgaggtgggaatatatctgatgtactcccagaacctcataacttttggtagctagttgacttattgctaatgcgactgctatgcacgacagcagggaaaactaccttaaataggaattttgttaaggtcatgtctttttaatggcattctgttgttgttgttaaacctgcaatctttctttattggacgatttttgtccatgctgttgattccatgaatatcctactatttggcaaaatgttaaaagaaagaatcaatattttatattgatttagctgaaagtagagaaaacataagcgttcagtaataatagaagctgagaaaagccggagttgatttagactctcataaattaggggagttttgtatctaggacttgctttgttcaaatggcaatgggaattccaaggggaatgctgacttcccaattggaagacagtattcaagacatcatgttagaccaaaaatctagcatgttaactccctaaatgattactttaaaatgagcactgttagatttttctggatttctaatagtccaatttgaggtgatgacatccactgttcttttttaatgacatacattctctcttcctgatatcatcaatgatttatccctcttttgattctttcaccttcttccttcgtacaacaatcttattattttttttttcaaagttcactggggaacatttctgctccctggtgtgtatttgccatatataagctaggattgtttttcagtaattcctggtgagtttaattttttttgtgatgttctgatctgctatgtctttactaaagatttttaccttgagatcttataatattaatataggcagaataagagggttgtagttactattttcctgggatgtctttttctcttctgttactttcgaaattttatgtgtcctgaatgttttagggatggccgttttcagctggacataatgagatattttacaatcaaaggtcaaattctctctctaacagttgaatttagtccatttacatttactccattttggtttaatttctcccattgtaattgatactttttatttgtcctgtattttctgtgttttcttttcaacattctagatttatttttgttgtcaaagaaattttgctctatgtaacttcatctgcctctcccttggtttgaaagattacactctatttctatcctgttatcggttacccttaaaattttgaatactcagagagtttaaatggaatctgtatttctacacttctatgaaatatcacaagaagttgagaatacttaaattccaaacacctcctttgcatcttttaagttcttccttcctcttctctcctattctggttggttactcccaaaattagacattattatttttgcttaatatatttagtatttgtgtaaatgtaatggcactaaccaatttcctcactcaccagtctcagtatttgagttgttttccttgtttccaaggtaattgcttttcgttgtgtacaattggctatgtcttggatgtttttcttgatgactaggtgtaccatttttgccatagataaaggtactctaggttgatggtaattttcttgcagcgttttgaagacactttattcactgcttcctggcttcctatctttgctgttgagaagcttccatcagcctaatggttgatttttgtaagtaatggctcctttcccacccctggctgttttgaacgtcatctctatgacttccgtagtttgccagctccctacattccagctaagtgtaaatttcttcttaatttatgtagtttgtgaattactgagctttctgaatctgaagagtcacagctttcataaatatgagctctttccagctgtgcttcctgctttactcttgcttttctagtatttaggatttggatctgatgtatatcagacacattttaactattttttttttttttttttgagatggagtcctgctttgtcgcccaggctggagtacagtggcttgatctcggctcaccagtagctgggaccacaggtacatgccacgactcctagctaattgttgtattttttgtagtaacggggtctcactatgttggccaggctggtcttgaactcctggactcaagcaatctgccttcctcagcctcccaaagtgctaggatttcagatgtgagccaccacgcgtggcctagaactcatttttttgttctcactgtctttctcactcttatgctccactgtttgtctctttgtcctacatttgtgtattatatttaatatctaatttctgatacactgataattttcttcagtgccatctaatcttccgtttaatctgcactgttttaattttaacgtactgtcacaaatgctctatttgttgtatcttttgtttgtttgcttttgccaaatctgcttgtccttttttttaaaccctttttttaacttgatgccctgttcatgcagtctgtttcctgctttgtttttgtaaacatcataaatgtatttgagttacatccaaaagtctgtatgtctgaggtgttacattctatgtttgagcatcccaaagtctgagttccttgaaggtctaacatgttgtttgcttctacagctaactcttgttcttggtggcttgttgccttctgtggtttttaatttgtgtttgcacgtttgttaacctgtgcatctgtaagaatccttttgcccattgttacgggggacgaaccaccttcccagttctaggcatcctgtgtgttaccaacatgatgccatctgatgtccagttattttcttgaatcttcttaaattctgcatctaaggtaatgtctaacacccaaacctttgcaaggacaattctgaaactacaaattcattacaggagacattttttccagcctggactttaggtctaaagggtacacttttcttttttcttctattagcaggtggatatctttttttttttcttatattagcaggtggatatcttttctagtccagtaccagactggcagaatactctttcgagtttgtagctgcaggaagggctttcaattccaaccccatcctcggtacaagatcaatatcttgtttattctctatcctgataatgactaagcccctcagagagtttcaagtcttctgaacacccaggtttcctgacttgctgtgtctctacccgctagcaattaatgacttctgctttcctagaattggttatgtgttttaaggaacattccactttttctagaacttccatgggtttttagtgggaatgttgtttgggcataaccagtctgtcatattggtggaagcacaaattgtacaggtcttcctttccattcattccacctttgcctcttacactcaccttcttcagtgaatgaggccagtagcttctcaatgaacctaattgactggacactctcttatttctctctagtggcaatttcttctatgagtttaatcttattgaaatgctttaagtgtatcccaattccctgctccaaatcctactatacttttccattgttcaatcataaatttaaatttcttctggaattttggatcccttataattttcacttctctacttagacaaatgagtgttgactccccccattgtacaaactcgactttttgtcagtgtgttttaagcaaggtatctaaaaatattcccttctcattcttattgccttgattcattttattgtgctcttctgtagaatgacttctcttcttccttattttgaggtaaatcctaatcattctgcaaatcccactttgtttatgaagattttactaatcaaggtggcaccgaccctcataaaactgtgaagcatttattgtaattgcttggaagtagcaggtaaatacattcagacttttactgcctattgttttatgggcattcactttgtcttctcaattacttttaattgtagcaaagatttttaaaaaatgatccattaatcccaaagtgcctggcataatgctcattctacttaatagaatagctgcacaagacatgcttttagaatggtctcttgcaagtaaaggtaaactaatgttcctttaagtttttttttcttagaatgaagaacatagcatcattcctttaattaattatgatattgcctgctaggactgggaaccattaagttcacactagatccatcgtttaccatgcagcatgaggtggtgggggcaaaacattctctgtgtacctggatctctccgtactttctctaagacaatgagttcatccagcagatgcaccacgtctcatttctctcagtttccctggtacttagcacggtctgtggttttagtcagaacctgataaatattcatcaagcatatggctggatcattgcttctgggactcctgagatacaatcagagcacatcctcacgttgcctcttactgttcccggcaacgccctccatgaggggaatctcgctctttccactggctttggtcacacaatccaccattcagttacacgagacgtccagttatagacaaaaaagttaaagaaaaaacatcctattttagtttatattttttgagactaggtctcactctgttgcctaggctggagtgcagtggcacagtcatacctcactgcagcctcgacctactgggctcaagtgatcctcctgccttagcctcctgaatagctgggagtacagatgcacaccaagacataatttctataccttttttattttcagagatagcgtcttgctctgttgcccaggctggagtgcagtggcatgatcatagctcactgcagccttgacctcctgggctcaagtcagcttcccaggtagctgggacttcaggtgcaccaccatgcctagctaatttttgttttcttttgtagagatggggtctctctttgtttctcaggttggtctcgaactcctgggctcaagcaattctccctggcacagcctcccaaaccaatgggattacaggagtgaatcactgtacccagccaagaaaaatcatcttgatttaaattcacaacttaaattgttgtaagggaggccaagatgggaggattgcttgagcccaggagttggagaacagcctggaaaacatagcaagaaccagcctggaaaacatagcaagaaattaaaatatttagccaggcgtggtggaatgtgcctgtagtcccagctactagggaggctgctgacatgggagggtcgcttgagcccaagatgttgggctgtgatcatgccactgcactccagcctgagtgacagagtgagatcctttctcaaaaaccaccaccacaacaaaaaacccccaaaacaacaacaataaaacaccgaataaatttacaacttctccttttccccagctgcagcttgatgaagaccagtcagttaaagtatatgggaagggggtgatgtctcttttcttacctctccttcttccctatatggtggctgtttttctttttttttttcccagggtctacaagagggaggagaggtaagagcctcagtaggttcttactcagcaggtatcatgacactctcattgatgacactctttccttgctttctggaattagctaatggtcaagactgaaatgctctcttttggacccatttgtgggctctttgctatctcctgtttcttatggccaaaggcaatgtgtgttgctcttcaggatggcaactctgaaacctcctcctctgcttctgctcctggagggcaagagcagagaggggaagctgcgtttgcaggctgcacacgtggaaactcatcgctgtaagatgatctcaagccaatgcagatgtgcagggttcaccctggtccttttatgacgatccacatgccatcaccctgatgataggaggaagtgaattttcagacacagccctgtgctctgcaccacaaggcagtttcatattctcaggagagagtcaggtattcccaagttcaggggatgcacatcaagtttgagaaaaaaaaagcgacagagaagattgaagggaaggcgtgctggggacataatgttagggaacggggaaatgtcatatacttgttatagtacatatgataacatataaaaacacatatttgaatgaaaaacagaactatagaagagaattgtaacataacagagtccacaaagttcataaaaattggctccatgtttgaccttccacaagaaaaataaagcccattgattcattaggagaaacggaggttgttctaaaacataagcctggatatttttagatgggttttaatataagagatggagtagtgaacatttgccatcatatccttacaacctatgaaagggctggcttaaaggacatatgtgcgttgaatccttcaacacgtgctgatgatgtattaggctggtgcaaaagtaattgcgcttttgccattagttttaatttttacttttagtatccatgctaaatttgactgtcatgtggtggcaaaaatcaaacaaacaaacaaataggactcattatccaaatacacagagtacaaaatgtcctgatattttagaaatctagaaggtaagtaagctacttctccttcaattactcttcattaagacaattcttctgactgggcttgatgagaacttaggtaggatgtagtgtggaattgttttttctgataagcaattatagctggctcattactgatattgacagaaagtggatctatgcactttaaggatcacaaaacagagcgtattatgcacatcttacattgcaagttatgaaatttgaaggagatttatttgagaaatgaaagaaggagcaataggcatttctcaaagaataagaaaaaatatatgtaagcaatttacatatcttcaggaaagtcactttcctgaatataatttaaataccttcaggagagtcactttcgtaaagatatgtaaatatcttgaagatacatgtgtctgtatttataaatatagatagatagctacacacacacacacacacacacacacacacacacacacacatatatatatatatatatatatatatatatatatatatatatatatatatataaagattccctggttttcctccctcactccctgaaacacagccaagaaaataatgcatgatttgacttttattacaagaagttataaagtccatgccatttctcagaatctcttaggtctcatggttgccaattttattttaccagcagaaatcaaacatcttattcgcttctcagcaaggcagtctcagcaaaactaaaatgctgaaatgtcacccttttggtggggttgattgcattggagtccctaggagatcacagagagaaaaatgattgatcataaatacagacggtgataggtgtgtctgtaatcacagagggatgtgagacaggcagacatggtaaacaaagacttcatgagcaaccacatgagggacatggccatggtctgtttgcggtgaggctccgtgaatttgcttttgtttgagcaaacatgtcatttaatgttggaggcaaaagacttctctgtaaatggttgtccattccgtcaccactcagtaaatatggaagaggtggactctatgtactaaaaggaacaacggaaaaaggttaaaattatctaaaattacaagtacaattagtatttcttttctaggtcgaagaagcatttcagtaatgtcaaaaacaggatacatttaagggaacaggagtaaaacatgcctaccttttaaaggtagatcttaacatcctgtctttacttaaagacaattttccttaaacctctcaacctggactattcctagagcaattcttctaaactttcagagacacaaatctcccacttatatgacaaatacttaaaatatgccacttgttctcacacatatatattaatattaataatgatgataatgacagctaatttcatagagtgcagtgtttactaagtatcatgcaaaataaataatgattctcaaaagctctgtgaagtttcctacctgcaattcaaagaagaaatagaaagtaatgtgcaataatataatttatgtattttcactgcatgacacaagcaagtgctccaatatttatgcgtgcacatcaaatcagctgtttgtgatagttgcaaatgcccttgacacacgttaggagtatggggtggggatggtgaattctttgtgccagggactcaaataccataaacagtgttggaattttttctgaaattattaacaactcttggtaagtttccaaataaataagctataatttcccctttaattacttggcaactgtttcctggaaagttcaatgcttattaaaaatgtgcaaaaaaaagtgcttgagtttagatataaaatggagttaggttctagatttagattcaggtcatcattgagaggttttatatatacataaatacctagcaggatatttcaaaattgttttatatatacatacatacctgcaggatatttcaaaatagtatgggaaatgatacaattcttcttttgtttcatgttatgtacattgctaaactttttctcattcctggcatttgtccactaaatgtcaacagtgataataagtatgataacaataataaaacacaaataactcacaaaattccacaatgaccccccaagatgagatagagccatcattgaataattaccgttctgggagatccctggatagacttcaggaactccttgaactctgaaatttgatggagagtatttatagagagctacgttcttccagggaggctgtccataacccccagaaaattatcaaatggtggcaaattctcaagctctcaaattctcgtgcgtgctcatgcctgttatcccagaattttagtagagatggagtttcaccacgttggccaagttggtctcaaactcctgacctcaagtgatctgcccgcctcagcctcccaaagtgctgggattacaggcatgagccaccatggccggcctatttttcctccttttcagttccgaatgttctcgttcacatgcggaaagtgaagtgatggctattagcatgatggctctgttagcaaaagagcttcaccttcacaagcacatgaatggcatcagttttctatctataacatcagaggacagaaatagaatatcaatgaagctaattctgataatggcgcagtttttttttttttttctagccagttcatggaataaaagtagagctttgcaaatttttttaaaattattattatacttgcaactctatgcttgttgtgaatgctggtctaatgtggacgattactgtgggatctggccagcagcccgcagtgcaacagggctctctctttgttcccaggtggatcggcaggttgagaaataatagacacacacaagatagtgaaagctgggtccagggggtcaccatcttctgctcccacggtgccaacaatgcactggatataccagcatttattattaagtttagtgagggcgggggtaggttagtgagggatttagggtcatttgattatgaggtgagatggtcacatggggatgaaataattccttaacataacatttgtatgtagaagtacagtacatttgtatgcagaagtacagtatacagagataagaatttacaatatagtgtgtgcgtcagtaatttctaacagagccttaaaacagaaacacaatctttccataacctatgattagtaagatattaattaggagtaacaattgcaacaaaagctggttacaaacaatccatggaaacaggacgtgaagctaggcaaccgtttagaccagaaattctcagaagggagtatgccttaaccctaaagaggcctagaagagccatggcaagatgagggcgtttatagccctatcttatccatatggacaggcactcccccatgcgtccgtttataggctctccatgatggtcacattccattcccagtgctatgaacatctgcttttctgggataggaatcttggtgatgtgaaacctccctgactgcacgtccattcataggctctctgcagggggaagcacatcacacgctgttggctcgttctggcagtccaacctggcattgtctttacacaatcctgcatgcaattttgtatttacaataatcaggagcatttcatcttttattccatagcaatagtttcagggggtctccctacagaagatggaattatttgttttactgtcataatgtgataccaattttataaaacacacaccttggtaggcacaaagctcttaccatagtaagaaaccaatgggtgaaacatatacttgggagtagttgtggttcgcaaatcattcataattgcaacaagatgaactgcactatcagaacatatcaaaatcaaagctgtaattgtccacaattataaatgtttatagtaggcaaaagtagcaattatcaaagtgtggttttcagacccttggagtccccaagatcctatgatggggtttaaaaccaggtggtcaaaacaactttcataacataatcatgtcatgtaccttttcctgaatgctgatatatgcacttcagtggtaaaacgatggtgaataaagctactggtgccttaaagctaatcaaaacagtgacactgaaaggtacaggtagccattgtgttttttttttttagcaccatgcagtctcagaaacaaagaaggggaagggccgtttcacttaagagtgacttggaggagacaataaaattgtatacagctcttctatgtctgtcttgttaataatctctacggtgacatggaaactgcttgagagcacttctgctgcatactgaagtgtgatggctgtttttgggaaaaacaagtgtgacgttgcttcagttgcatgctgaagtggctgctgttttcatggaagagtgaaagcatttgaaggaatgtctgatggactcaccatggtaattcagaattgaataaagtgagcccttcacttcaaggaaaaatcagatttttggaaaactttcattgactactgagaaatccctttagcaaagctattttcaaatcagattgctgatgtcattaacaaatgtgacttttgggccctgtatagtgaaatatgtccacatattgaaaatctgcataattcaatcaactgttgttttccaattgcatggtgctaaaaaatttaagtgagtaaaaacaagacaaaacgttgtgagtgcgacacagagcaatacattttccttaagaacatacaaaaagttcatggttgtgattttagattccacattgcacacaaactttaataaacggccacattatctgaaaaggctgttgaaatagtcctcctcttttgtacagagaggaatgaaccttgcatgtagtcagggttctctctaatcaggcacctgtgggctttctcactaccttcgttgttacagggtcactcaagggctggcacaaaggaaagcaaagatgaaaacagggggaaataatgaaagtaaaagagaagaattggggtttctgcaccctctctgaatggtacagcatctctttcttgatccttaaaccagaacaagtgcttctgttatcctctctacctgtgctaacgagctcagttcctggtttgttggtgcattgcattcaggataaaggaccctgtatcagccctttctcacactgctataaagaaatacctgagactgggtaatttataaagaaaaggggtttaattggctcatggttctgcaggccgtacaggaagcatggcagcatctgcttcatggaaggcctcagggagcttttactcatggcagaaggcaaagtggaagcaggtgtcttacatggcaggagcaggaccaagcgtgggcgaggaggtgctgcacacttttaagcaaccagatctcatgaaaactcagttactgccgtgagaatggcacagaggggatgacgctaaaccattcatgagaaaccgcctccatgaaagccaatcacctcccaccgggccccacctccaacactggggattacaattctgcatgagatttggtggggacatagaaccaaaccatatcagaccccaaagggaaagcaataaccagctcatcactgtcttggtggaacttggaactctgttcatcttctccaacctgtctcctctatcatagcaactgtgaccttgagtaagtacaacttcaattagcacaataagccattacctaatctgattttaacatattacaatttctgaatgggatgtatttagtttttgttgctgttgttttttaattaataggctttttttacatttacttatttattttttgagatggagtctcctctgtcacccagcctggagtgcagtgacatgatcttggctctctgcagcctccgcctcctggatcccagcgattctcctacctcagcctcccgagtagctaggactacaggtgtgcaccaccatgctggctaatttttgtgtttttagtagagatggggtttcaccatgttggccaggatggtctcaaactcctggcctcaagtgatccacctgcctctgcctcccaaagtgctgggattacaagtgtgagccaccacacccagccaatagcctttattttttatagtcattttagcttctctgcaaagttaagtggggcatcttcccgctgccccacatatgaatagcttcccctacaattaacatcatgcaacagatggtacattacaattatcaacctacactgacacatcactatcatccaaagttcacagtttacattaggattcacattagtttacattagagttcattagtgttgtgcatcttgtgggttttgacaaatgtataatgacatggatccaccattacagtctcatgcattttcactgccttaaaagtcctctgtgttctgcctattcttccctccgtccctcagacccctgtcaagcactgatctgtttactgtccccatagttctgccttttccagactgtcctacagttagactgtcagtctgtagcctttccacattgtcttgtttctcttagtcatattcaaggttcctccgtgtctctactggtttgatagctcatttctttttcgggaggggtgacattccattgtctgcatttaacacagtttacttctctgttcatctactgaagggcaccttagttgtttccaagatttggcaattatgtataaagctgctataaacattaatgtgcagttttgtttgaacgtaagtctttaattcattttggtaaatacctaggagcacaattcctagatattattataagactattgttggtttcgtaagacatttccaaattgtcttccaaagtggctgtattgttctgcattcccaccaggaatgaatgagagttcttgttgctctgtgtcctcaccagcatttggtttgatcagtgttgtaaatttgggccattctcacaagtaggtagtggccatttcatttttagagtcctcaaatagctgccccatgcatcctgtcctgatttcatagcttcattcagtgggtggatcaggaaaacttgtacatgccccatctgtgagctgaattgttttcttgaacaatttatatattgaacccctaacccctaggactttagaatgtgactgtgtttggcaatagagtttttaagtacatgattaaggtaaccaaggtcactagagtgggccctaattcaacaggactggtgcccttataagaaaagaacatgaggacacagacctacacagaggaaggaccctttgaggacacagggagaagatggcgtctacaagccaaggagggaggcctcaggaggaaacagccctgcccacaccttgatgttgaacttccagcttccagaactgtgagaaaataaaaggttgtttaagctgcacagtctctgtgatattttgttatggcagctcaagccaatgaatacaccactttatcacaaaccagaatgcaagaagtattttttttttttttgaaacggagtcttgctctgtcacccaggccagagtacagtggtgcgacctcggctcactgaaagctccgcctcccgggttcacgccattctcctgcctcagcctcccgagtagctgggactacaggcgcctgccaccatgcctggctaattttttgtatttttagtagagacggggtttcaccgtgttagccaggatggtctcgatctcctgaccttgtgatccgcccgccttggcctcccaaagtgctgggattacaggcgtgagccaccgcgtccggccagaagtattttttaacactgcgcccggccagaagtattttttaaagtgatgtgtgtctgtgtctagaaatactttttaatagaactaatttatagctccaccaatttaataacatttatgttcagtgtttgtttttaaaaattataaactttagaaaattataaatttgtttctgagtccctatttctctcaagagtcctgcttgaatgacaaaattatgtagtggcctcattcagcatccccctcactttgtcattccaaacttccaattttcttgtccttgtttcttctttttaaatgactagtttgttatttataggatccattggaaaccttttctttgatgatcctcttttccatattggtattaatcgttgatcaaaattataaaatgttacttcagtattcaataatattaacaaagtgtttaatccatccttgaaaatgaagtcaatatttttttgttttgttttgttttttgagaagtagtcttgctctgtcgcccaggctggagtgcagtggtgtgatctcggctcatagcaagctccgcctcccgggttcacgccattctcctgcctcagcctgggcgccaccgcgcccagctaattttttgtatttttagtagagacggggtttcaccatgttagccaggatggtctccatctcctgacctcgtgatctgcccgcctcggcctcccaaagtgctgggattacaggcttgagcctccgcgtctggctatttcatttttttaaatgactgtatacagccattgaactagctccaccattgtgaggcaaacgggagggtctctgtgcttaactattagtctatgtcttctggaataaatgagacctggccagggttctctggtaattggcaatttacataaagatgaaagaaaagtgacattaaaacctgtacaagtggtttgtgtcaacttggtgggggggggggggttatttaaacgttgtcctctcccatgattatggaggaaggtataaacaaatggaatttcagtttgaccctttagtatgattctttgtgtatacacagactttgaagagagaaatcaaagtggccatagagaacatttgcctcatgcaattaacattcacatccatgctaacgcatgttggggtggatgtcggaggagagctggatgccaaaacctggagaaaagagaccactgacaggctatctcagtgatgttgggtaacacattgaatgtccgaggcttggtctcatcaattctttaaaattatatgcaacctacttcttaccatcagaataaaataaagaagcatgcataaagtgctaagtcaattataaaacatcatacaattataactgatgacttattaccatataattattattaaatgatgcctttttgagaatggaagctgagttcgttgaagttctgccttatcctttaattatgggattcaatattattattgtacatttttcattcattctcatgatgatagcatgagttatcctttgtaactgttaatatgcaggcaagtttccaaacttctccaaatgcatgcatttaggataaccataaatcgacagatatttactgaaataatgagttctaattatgaatacaaaatggattaaaagacatgaagtatttacccagcaattgaccagattagcttaaaagaaggacttagtggatacttattctcatgatttattgcaaggacacataaatctgtgctttctgaagtttaaactatatatttggcacttgatttataaaacctgctaataaatccagctcaacttctcattgagaaatcattatcctaagcatcagctcttgctaagcatgaggatttataagcaaggaaacacgtgtgcgaaacctaccacagattgggaaatcataccaataaatcttggggaaaaaaaaaacaccattttatttacaaacccttacctgatagttaggatataagtgaaagatttagcaactatgaccttaagtacaattacaattagcataataagccattacctgatctgattttaacacattaaaatttctgagtgggatgtattaggcatcacagcatgaagagggatattattttaaatagacgcttgaagagatttctacttgcaggagttagaaggcgtggagatgctgtttttgtgccctgataatactttttaaagggccaatgcacatttggctgttggaagtggggactactaacagttcacagccgctctgctgctctggagaatgacccttggttgacagtgagttgctcctcctagaaatttatctcttatctctttacccaaagggtcccagagccaaagaccctctgacatgggagcagctggttttttcatcagtgaatccctcgcacccaaatccttgtgtcaaggtctacttctaagaaacccaaccgaaggctttcactgtctctaacaatgcttcacacacacattgccattcagactcatttgcattaccaactccacatttagacaagctggacctcacttcaagttgcaactaatttttttaatattaaatctccttacataagtcaaggtctgagtgctttgaaaatagcttctcgtttttccatcttgtgtttgctcatacaaaaatcagaggtggcttatgtgcaatcattatcttgctcatacaaaaatcagaggtgactttttatgtgcaataattatctttaaaagtatatcaatatttcgttgggtttgaataacctggagcagaaaggctaggtaatttgagctctatgtatttgagttgcatttcaagctaggcaagaggtctccactgaagatgagcgtgcaatgagatcctggctttctgacttccaaaacccctgtgcctcatcacagactagagtcatcattaagaaatgcattaagagcacaggacgttctgaaatgagcacacagtactttgggagcgaggaaaaccttttccattacttgtggatgatgatgaatgtagctgtagatgataatggtaatgatagggcttaaaaatattcaatacataaggaacattccatgcaggagctacttaaatggagccagggctattagtgcctctctttggtgattaacttagatgcattcaaaattttgcctttgcaactgttatcgccagcaagagaaactacagaggatccttcatctccctcttatggcttggaagtgaaaatgcaaccgtcatatggaagagatttggttcaatacatagaatggcgaagatgaacgttgaatttttatattgatgattagccttaggtgcagaatactgaattcagtaagagggatttctgtgagtatttctatggacattcatatcctcttgagatgccactttgcacttggggaaaactgaaaaatggcaacttctaatagcgcacggtgggttggaagaaggagctgcagatcacacagcctggattcacgtcacccctgcacctcttgctagctgggccaagtcatgtaacttgcctctttaggcaacagctctctatgcaaaattgttataatgatagcttccacctcatgacagttgtgaagatttaattgtgaagttaacacatatagtatctccacaaagctgcctgacaagaattctaaataactgtgtatatgtatgtatgtgtgtcacatctatatctaatctccctatctgatatatatatacatattctatctcgtgttatttatgtatctattgcatccatatctatctctatcatctattccatctatcctatttatctaccatctattctatctacatctatctcttcctaatctatttctctctctctgtctctctctctctctctctctcaccccctctctgagagagagctatatatatatatatatatacatatatatatacacacacacgtatatatacatatatatgtgtgcatatataggtgtgtgtgtgcatatatatatatatatacttatcggtatctgggtgttttgtgtgtatatatacacacactacacacacacacacacacacacacacacacacacatatgtggcatttagttaaatatcttggcaataaaattctaactttctttccaagcaataatgactgggaaaaagctcatgccagctagcaacttttctcttctctgttgatcttctgttctcttcacacattcactaccctaagcatcaacttttaactacattatactgtacaaattattagagatgttaatcacctcaactctcaagattaccctactcagaggaaagaatggaaagttcagactaccaagttagaccatggcaaagaaagagactgacttaggaatactagagactatgcacagagataaaggtgtgttacattcagaaaaaataagtacttagactcttacaactgatgctaggaattttaaatgtaacctaattgctatgactgaacctcattatctaagtgtgtgagcatatgtgttttcgcatatgcccaagattcgcaggggtcttatttctaaaaaataaaaaaagaaacaaaggaattatagtttcaaataggagaatctctactatttgttatttttgtgtatttgctgttatgtaaacataccacatttagaaaaaaaagtgaaatgaatgaaaggaaactaaatcaattgtgaattagatatttcttgttattcttgaaacttaggaggaaccacttcacattaggaaaattatgtctgtaattttcctcatgtcccaaaaatattttttgagggagacagtgtcaggacttggatgttgtggaatgtagccatgcaactgagacaaggtgttgggagtttgctggatgtgaggaggagatggaggaaggagtaatgtgaatagcattaccatatttcccttatgtcttctttatgctggttttcagaatataatgatacactagagaaatattttaaaatcccctatgtacatgctctggattttattttccatcccttccttcccaatggactctagttaatttggttttatcattgctctggattgccttatcattgcaatgcatatgtgtgtatctatatctataagtagatatagattgatgatagataaataatagatgatagatagataaacagataggtagagatacatgaaccggtagatgatagatcataaaatagatgatagattagatagatgatagatcaacaaatgatagatgatagaatagatgatagattgcatagatagataatagataggtagatagatagataaatagaattgatagacaggtagatggatagatagatataaagatataggttcatttgtaaaacttaagtaaacgtatcatgctgaaggtcattcttcatttatagttaaatttgagatggaatgaattgatacctgtaactatagtttattcatcttgttgattattccaatgtgggcagtttctaacttttcgttattccaagcaagttactgttagcattcttgtccttgacactgcacccatagcttgagcttctctcaagtggaaagctggctggtaggctgagcacatcttcaattctcctgatgtttcaagatagcgtcccaaagtggttctataaatgcacactatctccaacagagcaagggatcccttttgacttcatgtcttccttggtgcttgatactgtcagactttactttttgccatcttagtggagtctcattgctgttttaatttgaatttccctaaccagcagtaaaagaggtcttttcacatgtaattggtcattcaggttttttccttcatttaaatgctcttcttttcctttaatatgtcctacagaggtttttttctctttacttattgatttgttgaagtatgtgtgtgtgtattcataaatagagctatatataatagctatatctctatatatttccatacatacatatatatttacatttttatattcttgatattaattataatccctttgaataaaatatgttccaaatagttttcacaccggtttttctcttttttcagggtatctttaattttcagatatgttgatcatttgtattcaaattaatcgatgttgttttaaaagaatttgttcttcttgtgtcttatatgccaaatctattctatttcaaggaaattaatatttctacctatggttgctttcaaatccttcaagctttggtttttgcatttaggcctttaatctctctagattttaatctatttaatttttcatagggcatgagatagggatctatctttttacccgttatggataaccatttcacaagcacttttatttattagtttatccttttcccagtaattcgtaacaacactgctgtaaatatgcttccatatatgtgggaaaaaatttccaggctctctatgtagtttcattcttctattttttcaatgattattccacaattatgcccttactttctgtagctttataataaatcttgacaagtcctctacattattcttttttttgttctttcaaaattaagttaatcttaataatttaattaattaattttaaagaaaagtaactttattaacttaataaagttaattttgttaagtatggaattttaactgtaactttctctgggcactacaaacaaatctctgcttgttggcttctgtcattcctactatgagctgtattgctcctataattattattctgttgtatatgatgttttatttattctggttgcttttgtgagttttcacttgtctgttcttgaatttcagtttgatgtgccagggtgtggacttgtctttatttcccctgcttgggattcattttgtttcatgactctgcgtgttcctgtttcatatgattctggaatatttccatgattatcttttggaatattgcttgttccttattctcaggatgctgttattctccatcaccttttagtcattatatcctgaatctcttccatgtaccttccttctctctaaaactgactttgatacaatctatctgttgatatttatgtgctgcatcctaagtaattttttcatgtctctctgcccattcatttttttctcagttcagtcatgtgtaatctgatctttaatttatccatcgaggtttaggttccagggcttactttttacttctacaagttctcgtttttatttcaaacccatctgtcttttaattacaatatcttcctcttatttctggtccttcttcaattctaaatgctttttgtaatccaaatctgattacgtattatgttgttgtgattatattgctatttgtgccttttgaccatcatgagcactggattgggacttcacatgtattgtgattttttattgtgaactcatcttcaggagggtttttcagtgggaattgtgttgtgccttttgaccttcatgagcattgggttgtgacttcactatattgtgatttttttattgtgaactcatcttcaggagggttttatcaatgggaattgtgtgcagctcttgatgagcgtgttcctctgtagaaggtttttaaatgtgtttctgctatgagctgtagtgttgacactcccccaggaccagttcattttttacttgcatgttgcagcttcgagaagcatagtgattgtataaactacaagtctggatccatgcaatcaaaattaactgtcaaaaatgtacaataatgccatttttatagatcaagaaaaaacaaactttctttttcactctcctatactggcagaaaattatctttactttgaaaggtctcaacttagttggtgtctcagttccagctccatcaatccctgtagtttactaaaaccagcacaaaattcccagggtggcaataatgtcatgcacttatattcatgttgttttgtgttttttatttttggggtatgctgagttttttccttttggaggggggaatttgattttgcgtttaaaggacagctgttgcaccgtacatagcacttctagttgttttctaacaggagcattttcaggttatcaagttcttctcatcaatagaagataaagttgtagggttaggtttttcaaacataaatgcaaccccgtcacatccctgataacacgctcacacagtttccatttttcacttgaaatacaattccagtctctctgacctcacattctttcattcttcccctcatccactttattcccctcttttatcagtcgtttaaattcttgatatctgattgcaatgctttcccccagtagtgtgtgtgaggggtgtgtgtataagagctcattcatttactccaatatcagttcaaatgctactttctaagtgaggctttcttttatcattttccaagatgcttcccagtccattctctgctttaattttttcataggactttctaccaccttcaagtatatttatgtttgtttgcttgttatctgtcttttgcccctgagatgtaaggctcaggaaacaaaactttgtgcttatcttattgataggtgtatcatcttgactaaaagaatgccttacccatataggctcttaataaatatttgttgagtaagtagctaaacatctttatctctgttactacctcaaaattaaataacacagagggattttcaatccaggtgttttaatttccaatatccagattctttatgagcctactagttccctacctttcaactcctaggattttgcagagagaatttaaaatgtattaatgagccaggtacagtggcttatgcctgtaatccagcactttgggaggccaaagcaggtggatcacttgaggtcaggagttcgagaccagcctggccaacatggtgaaaccccatctctagtaaaaatacaaaaaatttgctggatgtggtggcttatgcctgtaatctcagctgctcgggagattgaggcaggagaatcgcttgaacttgggaggtggaggttgcagtgagtcaagatcgtaccattggactgcagcctgggcaacagggcaagactgcctctcaaaaaaaaaaaaaaaatatatatatatatatatatatatatgtaaatggttttcttgcaagaagatacatatatctgtttaggtgtatgtgtatgtatatatttacacatatgtttctgtatttttatgtatatatttacacatatatgtttttggtgtatatatgtatatacttacacatatgtttctgtgtatgtgtgtatttatttacacatatatgtttttggtatatgtatgtatatacttacacacatgtttctgtatatgtatatatttacacatatgtttctgtatatgtatatatttgtacatatgttcctgtatatgcatgtatacatttacacatgtttctgtatatgtgtgtatatatttacacatgtacttgtatatgtatgtatatgcttacacatatgtttctatatatgtatatatttacacatatgtgtttctgtatatgtgtgtacatatttacacatatgtttttgtttatatatttacacatatttttctgtatgtatatatattattttagagagcatgttataatatccactaatactattatcattcttttttaaaaatatatttataatctaactctaaatatgaatatttaaaaacatatttttatgtaatgagatccattgctcaaaatggttttctagtctcaccatcttcctttatctctactcagactttttctgttttgtttttctcgtggcccaggctggaatgcagactgcaatcatagctcatgacagcctcaaactcctgggcttatccttcagcctactgagtagctaggactcggggtgtgtgccaccatcatgctaatttttgaaacaattatttttggtagagatggggtctcaatcttgctgtgttgcccaggctggccttgaactcctggcttcaagtgatcctcctgccttggcctcccaaagtgctgggatttcagatgtgagccactgcactggccagaggttttgtttgtttatattgagtacttttgtgcatattagtctcagtaaggaaagtaaatcttctgagatgctgcatatattaaaaaaaattcttttcttttttctgtttcctttttccttccagtaaaatagttagtgtatataggatgcttggatcccagctgttttccagtcatagtatgtaatattaactgttttctagattcctgtatggtgatgagtatgtttgattcaagactaattttctttttattacaggtaatccttcatttgtggaggcttataaggttttttctgtgcctttgtgattaatcaatttaataagaattgtcctttttttttctatttttgcctcctacttcctgagataattttttcatttgtgtttctaaaatatcaatgtagtttattagcagtgactcatcactttttaacttgccttatttattgatttttaaattttaccaatatcattcttaaattcagaaagtctctttaaaaaatatcctcattttatctccttggtggtcacaagatctttcatctgtactctctcttttgtctctccgattatatcctcctcattagatgttgatagtgtctcttcctcatttttaaatgagataataatttttaaaattaattgagtttttcctctgcaccaaacaaagcagcttaccagaggaggctctcattcttttttcttttcttttcttctcttttttttttttttgagacagggtctcactctgtcacccaggctggagtgcagtggtgtgatcacagctcactgcaacaacaagcccctggcttcagaggatcctcccacctcagcctcctgagtagctgggactatacacacacaccaacatgcccagctaatttttttgtttgtttgtttattttctgctgtagagtcagggtctcagcatgttgcccaggctgatctcaaaccactgggctcaagtgatccacccacatcagcctcccaaagtgctgggatttcaggcatgagacattgtgtccaaccatctctcattctggtgggcagtagaagatggagcagtttaataggccagtaggcaacaacctgctcaagtgaggtccacccttccctaagaggtaaagggaggcttctgcttccaaatctctatagggatcaggaggggaaaatggtcatcctcttgtatgcattaggcacacagggttctggctggggaacagttgtgtcaacgcactcaggaagatgcccagagaagaacccactccaagcagcgaggtgaaaacctccacgaggcaatgcactagagaggtctaccagtatgggccactaggggctggtcctaaagccctctcctaggtgttgcccagagaactcccccataggttcaggaccccagatgccctactccctccttttatatctctagcaaggtttctgaataccaaagggactaaagccattaagttgctatccctggcatcttccaaaatatgttttctaatttgcaaccaatgaccagcagatttttctccagcttgcttgtttattactaccaggtctttgaactgtatatccaagctgggtggtatctgagagctgacatacgccagagattttcaaactctgttctgagcaccacttggcctaagggtgaggggtggagattgttaatgatagaggtggagactatgaatgatagaagtgctttctgattgttttatggattgctcttgaatccattgctcagaatcttatggatttctgttgttcttgtttttaaaggattgcagtttcagccacaattttatttgaagactcatgatccatgcagcttcctcatttcacatgatgtagaaaagccacacggcccatctgaggcaaggaggcactaactaaaatccaagtgttgcagtttgctgcaaaaccatcccctttacacttgtgtgcaggatgaccctgctgtatgaagataaaacaaacacactcttcctccaggtagatgcattatcctcagcagagaatgttcttctcataatccaaatgtgacactcattgtttctctttaatataaataattagacaagaagccttgaaataagaaaaggtaaaaacacatgggaaaaatacatattctttaatgatgttgttttttaggtgtttcatgtcttacttaaagtgtgcctaacaaagccttttctattaaataaggataaaaccaggataaccctttaagaaggtaaccaatcttaaaagcatcttacatcattgttctggattgagcacattcgactattattggaaacaactgccccataaccaccaaaatcaccattatcctgttgcacagacatttcaggctatgtttccaaagtacttttaaatcatttttattagttattaccctgtgctctagttttttaattggcagacattgtgtctcagtgccatgttcctaattaaatccccagactaaactgtgaaaactgcccccatatttttacacgatgtggacgccatttgaaaagggaatacatgaattttaattatgttgttcatctttatgcaacggagccaatcactagattttagaaaaatatattccacccaagtttgtctaaaatgttcctacattggggttaattgtattctataattctatgccttgtgaaacaagcttttaaaaaataaaacaaaaaacaaattccctttattaaccttgagaacatgaagctatgtgaaataaacttatcacaagaaaagaaatatgtgatcccactcataggaggcttctaaagtcatcagatttgtggaatgcaattcattcagaaaatagaatggtgtttcctgagggttggggcaggggaaatggggatttgttgtttaataggtacagagtccacattttgcaagatgaaaagaattctgcaagattatgttcttcgcagtgataaggatggagctggaggctattatcctaagcaaaccaatgcagaaacagaaaactaagtaccatatgtttgcacttatcaatgggagctaaacaatgaggacacatggacacatagaggggaacaccacacaatggaacattcttgagggtgggaggtgggaagagggaaaggatcagaaaaaacactgagctggtgctatgcttattatctggctgacaaaacaatctgtacgccacaccctgtgacccgcagtttacttattgtattagtccatctccacgatgctgtaaagaataccctgagactgggtaatttataaagagatttaattgattcacagttctgccccggtgggaaggcctcaggaaactaacaatcatgatggaaggtgaaggggaagcaagcaccttctttacaaggtggcaggaaggagagggagagcaggggaaactgtcacttataaactatcagatctcgtgagaactccctcactatcacgagaacagcaagggggaaaccacccacatgatccaatcacctcccaccgggtctctccctggacacctggggattacaattggaggtgagatttgggtggggacagagacccaaaaaatatcacctaaataacagacctacacatgtatgcctgaacctaaaattaaagttaaaagtaaagaagagagttctggagatttgcttactcaacaacgtgagtgttcttaattactactgaacactttaaaatggttaaaatggcacattttaggctgcgtgtattttaccataattaaaaaacttttcaaatttcctttaaactaataagtgtatcttcactgaacaaaaataatgtggggaagcaaaagagaaagtgttattacctggagtattgatttccaggagtttatggtgctgcatgtttaaatgaaccccaataaaaaacatgactattgccaaggcagattccgtggaatagtcgtcgtggtagtattcaagcagccacatgctggctcgtatgaatctagtagtttctgagctgaattcttttttttttttttttttccgctttgagacagggtctcactctgtcatccagggtggagtgtagtggcatgatcatggctcactgtagcctcaaccttgggggctcaattgatcctcctgcctcagccacccaagtagctggaactacaggttcatgccaccatccccagctaatttttacattttttgtagagacagggttttgccatgttgcccagactggtctggaactcctgggctcaagcaatcctctcaaagtgctgggattacaggcgtgagccaccacaccctgtggcagttacattcttaaagcaaggattgggaaaaagaaaatcgttgaagggattctatcttactgaaatcttagaactcttcctattcgatttcctccagttcggtttcaaactcctgcatgtggagtgaagggggaaagacaggttaataaccacaggatgatcctttaccagtgaggccgtgagggaactgggcttcctgacctgagggttcagacttgctccacttcattgcaaagaaactggtcatgcatcttttgccacagagtttaatgatttatcatcttctggtactttgtcgagatgacagcaggcatcacgtcgtttatttttctctgtggaatccgtatgaagttgagtggatggagcactctgcaatctacttatgcaacctacgtccaaccttctgcattgaacgatatctattgcttcagacataagaacgatttttgcaagatgaatttgggcttgtttgtatttgagctggcaaacaatagagaagtgtctctgatggaacttgcatttgtgcagggagaggtaacacacgcgactgagtgagtgatcataagagcaaataggtgaaattccacagtccctactggaaacctggctacacatcttttatcctctaaaatccttctgaggattaagtggtattatgcactgcctattgtttttctctaaatcctgtcttgtagaaggcaatgtcaataaaatagcatgcagaactgctgggccatccttcattgccagctgatcccacaaagcattttatgaacatctcagacaaaagatggttctatcctcatggaattaaatcaaattagtcccctccttaaggctcccaatggagacagcacttacaatgatggttgaaatgaaggaactcacctaaatcaaataaggtaatgcatgtgaaatgattctgtaagcttcaacaggtaaatttcagttatttggattatttttaatagtattattactactaaaattactattcataaggcaacttagaccattcttgatactttcagacagagggcagtaaactatgacccatgggttaaatctgacctgctgccatgtttctgtgtttgttaacagtttttttaatgactggtgtgttaagaatggttcatatgttaattgcatcactactcacaatagcaatgacgtggaatcaacctaaatgcccatcaatgacagactgcgtgaagaaaatgtggtacatatacaccaagaaatactatacggacataaaaaagaacgagatcatgtttttttgcggggacatggatggagctggaggctattaaccttagcaaactaacacaagaacagaaaagcaagtgccgcatgttctcacttataagtgggagctaaacgctgagaacacatggatacctagaggagaacaacacacactggggcctatcagagggtggagggtgggaggagggagaggattgggaaaaataactgatgagaatacctgggtgatgaaataatctgcacggcaaacccccatgacacacatttacctatgaaacaaacctgcacatgtatccctgaatgcaaaagttgaaaaaaaacttaattggttgtatatgtacttacataatcttctcagcattgcttcttgggtatacagactgaaaagtctaaaacattatctggctcttggggaacaacaacaaaagggttgcagaactctgccttacaaccatggctttataaatgtatgtttaaattcaaaaagagcttcaaaggatcttctgaagaaccctgaagagagggtgatattgcagcctctgtgtcaaagataattttaaaatgagtctgagcttttgttcagtaaagacaatgccactggaagctgggcttccggacctgagggttcagacttgttccacttcattgcaaagaaacgagtcaggcatcttctgccatagtgtttaatgatttatcatctactggtactttgtcgagatgacagcaggcatcatgtcatttatttttctctatggaatccgtatgaggctgagtggatggagcactctgcaaaagagacttccaagtttgtgagtggtctcttttctagaatacgttaaaagcattttgtaacctaaagaatttcacctctgttctgctcgttgataatttccctcttaaataattactagcaaaatgtttcagtgacacagaagttagtgttctcaaggaaacaatttaaatcgttctttaatgctatttacagagtccttgttaaggtatcagcctaatgcctttctaaagagggtgatgggttgtgggccagtctctcaggaacattttagttctcttgtgcttgaaagcgtagctttgcattactcaagggattgtggagaaatctgccttacagttcagagaatgcaattttcaaagattcgtgtctgtctttaaacatcttctgtcactctgaacttcccaggaggagcatgcatgcacaatggcacaatgacttaaacaatacatacatttctaggaaaagaacacatttggaaacttgcatttatagctgccagattaatgcatttggccagtttcacacgagacctatatgaaaatggtatagatgaacatcgataatccactaaattatattttttcctttttatatatccacttttttttttcactaaatgtgagtggcattttgatgtgaactgttaattgttactatcaaggctgtttattccggatcctatgtatcagacactgtgttacaaacatagacgcatgaattgaatgctcataggaacctcataatactaggagcacagtgtaataaaaaagataagaagtcaacatgaaaagatcaaattctggttttgttcctatcagcattctcatctataaatgagacaacaagaaagtgatgatagtggcaataaaaatatcacctagtttgaccttagagaagtattataagaataaaaggcaacaatgtctgtgaaagctttgaagtctgagtgatgcaatggctctgaaacagacagaagaggatgttgtaaggtgtagtcctaggttagctaagacagtgcacaacaaaaccactctggaaaggtttaatacatacaattcttcattcagagatgatgagaaatatatgcttcatatacaaaaaaaaaaaaaacagctctctgtctgtttccttctgtctcttcatctctgtctcttatctctctctttctctattttgtctctctctgtctgtatctctcagtctctcccccccacacaaagtggttcagcagagttaacattatgcatgttgtcacttatttgtgggagctaaaaattaaaacaattgaattcatgggaatagagtgtagaatgatgattaccaaatgctgggaagggtagtgggggtggtggtgagaggggaagtagagatggttaatgggtacaaaaaatagtagaaaaaatgaataagatttagtttgatagcacaacagggtgactatagtcaataacaatttaactattatttaaaaataactaaaagagtatcgttggattgtttgtaacacaaaggataagtgcttgaggagatagataccaaagtttacatgatatgatattgtatgcctgtatcaaaatatcctacatactccataaatatatacacctactgtatacccataaaaattaaaaaagaaaataccttagccacccatgtgagtcagggttctcagaaaaacagaaccaataggatatgggtgtgtatatatatgtagtgtatatatactgtgtgtgtgcatatatacatgcatgtatatatacacatatatatcatttgcatgtatatatacacatacatacatgcatgtatgtatgcacacatacagtatatatacattacatatatacacataatacacacacccacatgtgtatatatacacatatatagatgaatgtatatgtgtatatatatatacgtgtatatgtgtatatatacatatccgtatgtgtatatacacatatacacacatatacatgtgcatatacatatatgtatatgtagatatacatacacacacagatacatgtattaaattgttgcaaaagtaattacttttaatggcaaaaaccacaattacttttgcaccaacctatatacgcagaggaagaggaaagacagagggagaaaggtttattcgattgtgccagaggctggtaacaacgtgcaaagcaggctggcttgctggagaccgggaaaacagtggatgacgcagtcccgtgtctaactgctggaaacccaggctgaatttctatgttggagtctggaagctgaatttctccttcattgggaaacattggtctttgtgcttgaggccttggactgactgaatggggcccacccgtattacggaggacaatgtgctttactaaaactcaactgatagtaaatgttcaccacatctcaaaagaaaaatctcttcccttggctggacttggtggctcacgcctgtaatcccagcactttgacaggctgagtcaggaggatgacttgaagtcagagcaacatagtgagacccacctgagcaacatagcaagactcatatctataaaatttttaatactttagccaggcattggggcttgtgcctgtagtcctagctactcaggaggcggaggcaggaggactgcttaagcccagaaggttgaggctggagtgagttgtattatttgcaccactgcactccagcctatgtgacagagcaagaccctgtctctaaaacaaacaaacaaaaaagttccttcccaacaacatctagactacgtgttcggacaaacaactggtcaccagtttctagccaagcagacacataaaactaaccatcacaccaactatagttgtagtaacttttaaaactatgtattttttatttcaatagcttttggggtacaagtaatttttgcctacatggattaattgtttagtggtgaggtctgagattttagtgcacctgtcacttgagtagtgtacattgtacccagtatgtagttatttatccctcacttccctcccaccctcccaacttctgagtctccagtgtctattttaccactccgtatgcctttgcgtattcatagtttagctcccacttataagtgagaacctacagtatttggttttccattcctgagttacttcacttaaaataatggcttccagccccatcacaaagatattatttcattcatttttatggctgagtagcattctatgctgtatatataccatattttctttatttactcattggttaatgggcacttaggttgattccatatcttgcatttgtgaattctcctgcaataaacatatgcgtgcaggtgtccttttcatataatggcttcttttcctttgggtagatgcccagtagtgggattgctggatcaaatggtaggtctacttttagttctctgagaaatctccatactgttttccatagacgttgtactaatttagattcccaacagcagtgtacaagcattcactttttgccatatccacaccaacattcattgttttttgactgtttattaatggcccttcttgcagggtaagttggtatctcgttgtggctttaatttgcatttctctgatgattagtgatgttgagcattttttgttggcatgtggagcatgtttgttggcatgttgagcatgtttgttggcatgtggagcatgtttgttggcatgtggagcatgtttgttggcatgtggagcatgtttgttgaccatttgtagatcttcctttgagaaatgtctattgatggcatttgcccactttttggtggggttatatgaattttctttgctcatttgtttgggtaactttaagaatccaagtaactgcattgtagtgtctgtttaatctgccagccacagtcatatacttattgaagcagacgcctcttcctcccatgaacggggatgtgcctgtacccttcccaatcaatcagctaagaaaaacctctcagaggggtacagtaggctgtcttacagcccacatcgtagagacaggccagccctgtggaatcacgttggtttttgaaaggcacaaatgaaaagatacactgagaagctttggaacacaagatacattttatacgccctttgcagggtcgtattcagccagagtccgccacattacagacatagaagattttcagggtcttcatggaattcttgctggaagtaactggtgcgttgtttttgaagcttcctttgatcttgaattgggtctatcaggtaaacacactgacctgtcttcttagcagccaattgctggtgacctttccacagcttgtgtccatccaggagttcagcaaaagcctggcctttcctcctgctctgagcccagctctctaccagccgctttgaatccttgcctggatggtacctacttctctgcagaggcaaatcaacacagtagtgtcatgaatctgtactagtttattagttttagttttctaggaccgctgtaacaaatcattacaaactgggtggtttaacataataaaaattatatcctctgccagtcctggagaacaggagtctgagaacaaggtatgggcagggtggcatgccctccggaggctctaggggaggactcttcctgcctctcccaggtcgtgggggcttcagatatccctaggcttgtggccatatcacttgtctctgcctctgtctctatgtggcacgtggcattttcctctgtgtccatgtctcctcttctgtctcttagaaggacactggtcattgaattaaggccaccgtaagtcagaataatctcatctccagatctgactttaattacaaatctgcaaagactatttttctaaataacgtcatattccgggttctgggctttatgatgtggatttatctttctggaggcaactgttcaatccactacaattgtatccagtcctttccagagatgctagaggaggaaccttcctgcctctcccagctcctgggggctctaggcttccctgggcttgtgaccacatcactgcactctctacttccatctccacgtggccttctcctctgtgtatgtgtcttatcttttctgcctcttagaaggaatttaagattacaactgctgctagatttccccttattgctctggttaaggagtccgtggagtctcctgtagtatgaaaggtttcgttttacattgcagtcccttacaaggagggcttaggccaatgtctgtgctgacttcccttctacatctctggattctgtctcaccggctccctgtcatttccccaaagatgtcctccacccacctcatcctactcttcatccctgcaacatctgtcctttttttttttttttgagacaagatcttgctctgtcacccaagctggagtgcagtggtgcgatcataactcactgcagccttgatctgagtccaagcgaccctcccagctcagcctcccaagcagctgggactataggcgcttggcgattttttgttatttttttgtagagatgggagtctccctatgttgcataggctggtctcgaactcctgggctccagtgatcctcccacctcagcctcccaaagtgctgggattacaggcgtgagccaccgcacccagccgacacatttaaagaaatgttttggcaacttatcaaatacccacagattggatctaatcatttaaaaaacacaaacttggttgtagactttctgtccttctgaggccccatgactatgtagtcccaaactattctcgccgatcacaaaggaacattctgtttagggctacttttacctttgcttagaccatccctttattcaattaatgtttgaaacatcatacagtgggggaaacagccatgctatggagtgcgcaatgtttgttaaaaattaaacaaccactcacccctccttgccccagtgaccttttcttatctaatctttttcttggcaccggtaaagagaacagcctttcttcacataatcgctccatggcttctcagcagaacataaccaaccgccttgctgaggtggcctagggtgaccgggtcttcctatcttttgtgcagagctcttgtcatgcgcaggagtttggggagatgccccccacccccccgcaaaaggtttcctatggctttaaaataagaggtagttcaggaacattaactgttcactttacatttaagatatgatctcctggagatgttgatgtgccagctggtcttgttgagaggcagttactgatctagcaggtgtttatagattttacacctgtcttgttcttttttttaaaaagaaacaacctgcaactaactaactttatttcgtatgttaatgagacagatgtgaaagaacacaaaatcaaaatgcttcccaggattcacagctctagtgttccttggctttatggtttggaaggaaagctgatttatataggcagaggctctctatataggtccttacctcccctgtcctgttgttttggaatgtgagcagaacacactcaggtctactgtatgaataggacaccctgcgccctgaaattccatcagcttcacagatctctcgtggattctctcagagtgatgactccctctccctttctccagtgtctgaacactacgtggtaagggactttccacgcacaatattactctcagcagacagaagatgctttcctggagaagaaagcggcagtatcttccagaggcaattggagttttcaaatgttggtggagttatggggttgaaggctccagctttactgggtagagtctcacgcctcacagtgcgcttgccctggggcccactggctgtgtgtgggtgcttgtcctcaaaactgtagcagcccagtgcccctggagagccactttacccagcatcactattaggtgctctgccagctctgtggcatggagaggaattgtctggtaagaacggaatgttttccattctctccatcaagaactcgaaaggctgattgacaggtgcaaacgcaaatctggtcatctaggctgaattacaagatgtctggtggaagttaagagacttcaggaggtattaagagggatggaatacctggaattccttgggggccaggagagttgagccatcctcagagatgtgtgcatactgcaaacctcctttaagccagggcactggtattgtgggaagcccagttagggattagagggattccagaattaagatcaacaaagcagtctgacaccctttggggtgccagagattatcacttagattgaggacaggggaaagggggtacactcaactcaattgcttcctataaaatcttacagacatcaatgatcccagaggatggggagctacagtgtcatctcagatcattttccaagggaaggatagatgaccccataactcattatctctaagagagaatgagattccacatgcaagataggaatcaaaacccttttcaccaccttcattgactcagttatgcaaatggccctagctcatagcctctaagcccagagcagacagtgcatcctggttgctgattgcatacctcctgatgggttgtaactgtgtgctttacggagggctagtgtaaacattctcattgcaaagcgtcttgcatggatgagcagacatagagtggcatttgccggagctgagcacccctgacttcagagttcacgtttggcaaagtgatttgttgcactacttggcaattgaagcatcccgaatagctttgttttatggggtggggggcgggggcgaggggaagagagtggagctttctgtctccctactaatcaggagggtccttgtttgggctttaggccccttcccttgttttctgggcagaggaattgcccctaggaatcctctgcaggccctgccagtttcagagctccctcattttcatctctccacttcaatgagctcattcactaaggctttcccacagcccaggatctgacttgggtgggcctgcttgggttttgtgtgcctctgtgccaggaagagaacaggcacagggctctgcttggctattgccggcattcctgggctagtgcgtcacggggtctcatggtgacagcattccactggaaacacggagtcccggaacccaattttgaaaggaatcctctctaaaaatctttcaggagggagaaaacagagatttcagagagttaacagtgctcctcaaaacagcgtttgtcaaggaaattagtagcgacttgtatgacaccctctttctcctgtgatttcactttcctaaatgttgattgctccggggtgtggggcttttttcttctatacccaaagccacctagtagaagggttaagtgcatagactttttccaggcgatctctgtgttcataaagagaagtggggaaagggctctagtgtttcaaatgtaaagtaaccattgttaggaaaatgacttattctttctttcattcatttatacaaatgtaagttctggctatgcttagctactcaagggaaatcagaggcaactgggtcctctagggatgtttagcaatatctggacacgttttttatttgtcctcgctgggaggttgttcctggcatctagcaggcagaggcccagcgatactacagggcacatgccagcttcccatcataagaaatatctccttccaaatgtcaatagtggtgttaccagaaaggggtctctatccagaccccaagagagggttcttggatctcgcacaaaaaagaatttgaggtgagtccatagagtaaagtgaaagcaagttgattaagaaagttaaaaaaaaaaaaaaaaagaatggttactccactgagctgctccaccgaggatacttattattactccttcattatatgccaaacaaggggtggaccattcatgagatttccaggaaaggggtgggctgttcctggagctgagggttcctccctttctcagaccatgtagtgtaacttctggatgttgccatggcatttgtaaactgtcatggcgctggcgggagtgtcttttagcatgctaatacattataattagcatataatgagcagtgaggatgaccagaggtcacttttgttgccatcttggttttggtgagttttggccggcttgtttactgcaaccagttttgtcagcaaggtctttatgacttgtatcttctgccgtcctcctatctcatcctgtgactaagaatgcctaaccttctgggaatgcagcccagcagatctcagccttactttccccagcccctattcaagatagtggagttgctctggttcaaacgcctctgacagtgggatggttgagaaacttgggggtagaccaagggcaaggcagcaatctcagcctgtggaaaacattttagtagatgccattgtaatgtctgaagtcattcaattataatgtcaaactcactgcaaaacatgcattatctaaatatctcttatagttagctttctttctctctctctattttgctctctctaattctacattttaaaatcatatatgtactgaccaatacgatgtttggctgatcattggaaaggcaattggagaaacttagcagccctgttgaaatcctcgacatatgccatctccatgcaaattcagtacaaggcacaatagtaaagtgtggctatgatatcatcaactttgaggggcctcatttccccccctaaatccctagtctcaaagcctgactccactttcttctgccagccaagaagcttgtcaaagcctgagggcatcattgctctttccccatttctagcagatggccgtgttgtgagacatttaatccactgactgaatcagttacagtaataccagtggcttctgaagatcagcctcaaataacagtagctcaatgaacataaatggcatcagaaaaacacaagtaactgaagaaattacaggggtttatgtccgctctttcttcgttcagagaatgttattctgtgggcattactgaaaagggagcttttgttaatggctgatcttagaaaccagacttcttctacattgtgattctactaactccaacatgagacatctaagaacaagttggggattttttccattgcagccagcaaggaacagaaaagagcgtgaaggtttgcatgtcataagtagcacacagcacacaaccgccccacccaaccccactggtgagaactgggctccacaaagacctctggcacatgggaagcttggaagtgcatgtagccttgtgtgcctgggatgaagaagacatgggtttgctgagccagcatctgatctgcaaggtgcttcatcatttcttcaccatgtgacctctgcaagtgacttaacctgtccggacctcagaatgctcttccacataatgagacctgcatgagagtaactgtcaggtcacatctggctccggatctcataattctttctgtcttcactttcatccaggccctttacaaccaagcaccttcactttcaaccaagcaccatggagagctcctttggctgatttttgtttctcataatctgactgtcttcaataactgtatgaggattcttcagagaaatacaatcaacaggataaacttatcctattgatagatatgtctatttatctataaattaaatagaaataatatagatataaatagatggatacatatataggtggatacagaaatagttatagatacagacaggagatttattatgggaattggttcatgctatggcaagatatggagacctagcaaagctcattttttaatttaatccaagactgaagtccagaaaaccataagagctgacggtgtaaatcctggagccccaaaacctgggaaacagggccttgattttgcaaggcaggaaaaggtgaatgtctcagctcaagaagaaagagaatgtacccttcctctctctgcctttttgttctcattaggccatcaagggatttgacagtgccagcccacattgttgactgatcttctttactcagtccactgattcaaatgctaatctcttctggaaacactctggcagacatactcagaaataatgttttatcagctgtctgggcatcccttaggccagtcaagttgacacatacaattaatcatcagagtagagtttctagtaatgcttttggttcttctaactatttttgagggtacaaagagcgagcaagaccactctttggaaactagccacagccaaccacgccagccaattctaaagccatcatgcggggagagtgagccctacagttcccaggtgttgggtccccatcccaccactggaggccaccaataaagcaggtggtggaaggtggattcaggggcatcaactggagtgacatttgactgggaccaagtcagttgaggatgcatcacgtagatttgaagtaattaaaacatggctacatatgtaaggtgagggaagcatcttctttctactcaaattctctcttgtccttctgcaaaaagcagagctacttgaaccacatgaggcccagtttgtcacctcattctgacataattttttctggtttattattacaaaattttaatgagaagaacgcctctaagacaaatgccctaagaggaacatggaacattcatctttattattcttttggctccatttgaccaaactccctttgtctacttagcatattcttatggtttcttgaatgcaagtattctctttttttctctctctcttctttgatttttgtctgttttttttccaacctatacaactgccactgaatatagtgatgcattaagcataataaatctataattaactgataccatttcctcttccaaaattaaacttccaccttttacatctatttccaaatttcttgtttctgtctgcataacaaaatgcatctctaccttttccaacatatttctgaattagcactaggcagcatgccttctttaaggcaaatagacaaatttaaaattatatattagaaaacacttcttgttctctttctttctgtaaactacctgagttgaacctgctttacttcttctctgctttgtatcacttccttgctattcctccatatcaataattaacctgttgacctgtcactcaagactgtaggaaatcttgctaacacatttgtgtctgcttttatcacctttcacctctcaatgcacacactctgctgaactgagattgtgttctggtctcacagacaattttcacataactctgtgttaatattgcggggtagacaattttcacataactctgtgttaatattgcggggtttttgttttcgtttttttgagacagaatcttgctctgtcgctcaggctgcagtgcaatggtgtggtctcggctcactgaaacctctgcctcctggtgcaagcaattatcttgcctcagcctcccgagtagttggaattgcaggtgagcaccacacacctggctaactttttgtattttagtagagatagggttttgccatgttggccaggttggtctcaaactcctggcctcaagtgatcttccttccttggccccccaaagtgctggggttacaggtatgagccaccacgcccagtccaactctatgttagtattttcaccgacacaatgacctccccatttcattctgtcccctcaggtgctacacaactctcaggtccaagtaacaactttaacaactgagcttcatccattacttttgggtgggctgtttactttttcagtaagtgtaaagttggttggattgtctattcttagcatcataactatagttcaatacaagaaatcttacacccctagtcggaactacccttctaaaaaatccatgtgtacactggcttcaggaagctcaataaccattgaaagtcacatagaagttcaatcgtctgcaattctagagaactccagtagagatacacaagacttgcactagtcaaggcaatagtgaattaattgtggtcttacatgttctgtgtcctgaatcaaagacatcaaaacctgatgagatagtcagcaagttccttgttaccgaggaggtcacataagtaaaaaggttcaggtcacaagatcaacacacactattgcaaaaaaacacacaactagacttgaagaaaatgtacatattacaccatcactgtagacttcaaatgcccaaagttgtttttagtttttgagatggagtcttgctctgttgcccaggctggagtgcagtggtgcaatctcagctccctgcaatctctgcctcccaggttcaagcaattctcctgcctcagcctcccaagtagctggaactacaggcacgcaccatcacgcctggctaatttttgtatttttagtagaaacggagtttcgccatgttagccagggtggtcttgaactccctgacctcaggtgatctgctagccttggcctcccaaagtgctgggattacaggcatgagccaccatgcccagccccaaagttgattttaaattgtaatacagaacatagtaaatttggaataagtaagttcctgccacagtacgtctaccctgagatgatataaactaatcaccatggttagcaaaagctacagttaggaaagtccctttgaaaattgatggaatataagcatttagaggaacagaactgcataaataactacacatgatactttaaagtttatttttagtttttacttctgtttgtgacacaaaggataaatgtttgaggggatggaggctcaattttccgtgatgtgcttatgatgcattgcatgcctgtatataggataccttctactgagattacgtgcccttcaaaattttcatgcatatatttattaaatcaatggaaggtattttatataatgagcatagcaaatgattgataagcttgtattgactagaaaattatcaggcagatataataaagtagattattttaacaaatatgaccaataatttttctcaacaattcccagtaatcagacaaatgccagtaattggatttacctaaaagtactaactttgctattattattacttgaattacttagtattaagaataggatcccgggaaaatcatacatttttttctacaaataattattaaaacatagtaaatgaattgttaccaatcccctcaaacaaagtagggttaattaaaaagttaacatccagttttctaacactaataaaagaatgaatgaatcaaaatttaaaggatgagacttgttcaataatagagaatattgtattctaaaagtaaagtagaaaaataaaataagtggaaataattatgttttgggggctacatttttgtcatatcttcacattttgaagagaaaataaaattacattatcattgtataatattagtcaattaacaattcagaatccaaataacaacagtttagaaagattgattaatactactactgtctatttataattactctgtaacacttttaaaaaaaaatctaaagcagctaagcttcttgtaactcccttgggcaatctaaagacagattaatttttcaattacagaaaataaaaatataaaccatctgtgccagaaaaaaaaaaaagccactgtagtttatgcatgcttctttatttaggggttttagtatttcgataatgctaacatgtttttaccgtgtccaattcaattaaatcttaaatgttctgagattatctgtctgccgagataagacatgatgtctttaaattataagatcaaagattccccgtagtttgtcaaattgagtatggaaaagaacatgctatgcaccattaacaacactaagctaaacctcaaaagaggttaaatatggtgagatggaaattgaaaggcttagtctggctttagcatctaatggagagacagcacagcaaacactctccgataccagcaccaatataaaagggttattaatagtagcaatgaacaatgaatgtacacagaggtactgattaaggagttcacaccgctatggtagccatgcaataaccactcaactaaaacttggggaaacctgtgtctattctgtgcttctaaccctatgtgccatcttgcaactctgaaatttcgcagacctatttctttacacaacaaagaagggaggtgctgtggaagtggggaccccaccatgagcctcttgctgggagtcatggcaatcacttgtttcttcctaaaggagtttgtgcctcaggagcagtgagggatttgcaagaagggaagctacatagagaaacaataataggatcctcattgtcttctgttctcctccttccatactcctctgtaactgagttcaacaagaatccgcatatcctcagaagagtagccttcacatttgtgaagtggaactcaagtgcctggtgaagctaaaatccaaatgaaaattgacagctctcttacacatatgcatggctgcacctcttggaaacatgtgctgcagtttgtcttggatcctgaaatgtgctttttctgcccttggctcttgggtcacccttttctctgcatttcgccctccttctctggaaagtcgcacttagtttctttttctttttctttttctttttctttttcttttcttttcttttcttttttttttttctgatggagccttgctctgtcgcccaggctggagtgcagtggtgtgatgtcgactcaccgtaacctctgccttccgggttcaagcaatcctcccacctcagcctcccgagtagctgggattacaagcatgcaccaccacgcctggctaatttttgtatttttagtagggacggggtttcaccgtgttgcccaggctggtcttaaactcctgacttcaagtgatccacccgcctcggcctcccagagtgctgggattacaagagtgactcaccctgcccagccgtcttgcttagcttcttcatcttctgctgtatcctaaaatgttggtcctcttccttgttctgtagcaggctcctttcacactctgcatacctcccccacccaaaggaatttcaagttccactggttccaaaatgtccccatttgtattccaaatcttatttctgaattctatgtccacatattcaatcacctggagatcttcactttcccttttgtaatctgttccctaatccaatttctcattcacaaccagcctgagaatcctaaattgcggcttataaaaatccaggttcctggagcctggtcctgtcctaaggagagagaatggttggggcagaactagatcattagctttattaaaagatactacagtatctttggtacctaaaacttacattgtctcaggaactaactggcttctttttttaaacttctgccttccgcattctttacttcaccacaatgaatccctcatctatataaattcataaagatggaaatggtcttcattttttttcctgcaaacatctctcaaatcctttaattttctataccagtgacactttgtagtcgaagctggcaacatgtcttgccgatataactacaaaactttctaccaattaattgtgtacagacttgctcccttccaattctgtacactgttgccaaggatcttactaaatacatctcatattcccctactgaagtgtctactatggtgtgccattagtaggacaatctctaaactgcttccatatagactcatgggtttacacaaggttgataatcactctcccccttgcagtctctgctccaacccaatttctaattaacagccagccttagaatcctaaatcgctgcttgtaaattccagctgcctggagccccatcctgccctaaggagagacaatggttggggcagaactagaacactggctttataacaagctcactggaaaattcatgtgcatcttgaaatttgagagctactgctcggcatagcaaatgccttcactgcacctcattgccctgggctttaatggtatttggtgttcctagttctggcttcccacaacatatgtattgaccaacttctatacagccattacttttttggggcggtcttccctgaccctaatttaatggagtctctaaagtggccacctatacactcaggttgcattcttgtagtgtttattaaatttcagtgttttgtttatctctgtgtggcttgatggtggactccttgtggatagtagctcattttcttggccagcgctgtgctgtatcccacatacagacaacagggcctggaagacccttagtttttggtgaaaggcttaaatgacaagttcaggctcttaaaagatgaggtaattcgacaatatggggctgaatgaggagaaatctgcatatgagcaagacaggaagaatctctctgcattgccagaaaattgcatgtctacgaatgcctcccaaccagatagcacagagtttcagacacaggtaaggcatacagttccatcaggctggatgctaatatagaaaaatgccagaaatggaataagagagtgtccagaatgtataaatgtcatacactcgggttgtgctgattctagttgacagacagaattagggactgaaaaagcaggtatgaaccatttcaaatacactacactcatgaaagctgttaataagccagttctttgtatgtcagtgcttcctaactgcacagcaaccaagaggaatttgagcttcctactcctatatccatctccattagaatagtgtaagccattctttaaacattaaaaccaggcacccacatccttcttgctcataaatgttctgtcttagcccatgcctaaagcatgccaatttcatcaatattcactttagactgagccaggtgaggtctattcttgcagtttccctgatagaatttctgtggagtccttctcaacatctgtgacatcagaatggtgctttggaattctccttttgttactctgagttgaacagtcctcaactcttgaccatctgtggcatcaacagaacataggccaaactgagccctgatgaactgaagcctgctcttcaacaggcttggagctaacagccgtctgacacgaacacagatctggtcttatactggaagtgaatttaaaaaatcttcaacgattttccttcactctttctgatttgtcgattgcacaagctcagcactttctacttgctatacgattctgtcttagtccctaagggttattccatctttcgatttattgtataagccatgatacattcatcattttctcactccttggatttcattacctacttttacttccgttgtaaccagaaccttcttcaactctcattttcaacactcttgacatttttttctgcttcccagacataagcaagttagttttgttctgtaacatctcaaaggaactctgagacaggggtctgaaactctagtgtggccagggtcccagaaaggaaaattgatgtgaaaagcaatatgggtgagaaaatcccacaacagaacaagcacagaggtgaataccccacaattgggcatcaaggagagaacaggaatgttgagctagtggaagttgcctactggtttctaaggcaatatgtcctttggcatgctgtaatattatttttaacaaaaatgtagacatggagcatgaaaatgaactaacagtgtaaacggaagctaggtgaaacccttatcaaagacccagaaatgcatgtaccaaactaactgtgaaatacaaccaaaccaaaccaaaccaaaccaaaacaaaacaaaactgtttgaattataaaatttgagagtcacgaaacaagatgaagaaattgactttgccgtgccaaatatatattttgttttctgtggtgtttaggcaattttcacaagacatctttattaaatttcaccggtctctctgatgaacttttggacattactactttttgagataaatttttgaatttctaaatttctttataaatatgtaggggcaccacggttttgacgatttctatactggtggtatagatctttgttttaaggattataatagcaattttatccgttcacttagttaggattaaattctgggcaattcgttcttagcaaccagtctcgaaagtgtgattatacaagaagcagccaggcgtggtggggctcacctgtggtcccagtctttgggaggctaacatggaaggatcacttgagcccaggagtttgagtctagcctgggcaacacagtgagacctcaactcttaaaaaaaaaaaagtataaattaaatatacaatgacatgaataggagattgactatcagaagacaccatttgggagacagctatagcactccttcatgggtaaccttgataaagaccacatgaaacactgagtggttattatacaaggctgtctgctaaacagcctccttttatcagctcatttaattatcttatccattggggggtggcaaaactgtgtttcctctcttctctcacttaatggatgaagaaacgaagactcagatgggttagctgattcacacgacagagtacttggtgctgctggaattaactgtgaagtcatgctctcaaatgcacccataagccacctaacattttttagcttattctctcatcttctctgttaaacaaaaatccacctgctttcacaacatttttgggatcaattaatacttattaaagtgggctaaacctcaaaccactctgagagtaggaagcattatatttgttattttaaatttacaggcaaattttccacctgcattggaaaacacagtctcaccaaagagccaggacaagacttcttttcagggccctcttcctggttgataatcccacccagcaaaaccaaatgcaatgctgacaaaacttgacatctgaactgagagaatttggggtacgtgcatactcccattaattagagctgcttgatgtagagtgatgtttccaaaagcattctattggaacaatagtttctcaaaatcatttgagttcaaaggatctatggcaaaaacaaaaaaaaataaagcttagaaaacatagcacataataattgtttcagccaggtttggtggctcacacctgtaatcccagcactttgggagcccgagacagacagaatatttgagatcaggagttcgaatccagcctggccaacatgctgcaaccctgtctctactaaaaatacaaaaattagctgggcatggtggtgtgcgcctgtaatatcagctactcaggaggctgaggcaagagaattgcttgtacctgggaggcagaggttgcagtgagctgagatcacaccactgcactccagcctgggtgacagagcaagactctgtctcaaaaaaaaaaaaaatccttgtagattcataacacacataatacacaaataacacacaagattatgcaaagtgctaaggttgttgaaaacataggtgtttaactatatatattttttggtttacacaacagacatttgtttctctcgtttctcacagttctagaggctggaatttcaagaccaagttgttagtagggttggtttctcctgagacctctctccttggcttgtagatgccatctcctccctgtgtcctcatgtggctgacactctgtgtgtgtctgtgtcctaatctcctcttactataaaaacacaagtcacattggattagagtccaccccatgacatcattttaccataattacctcattaaacgccctgtcttcaaatgcattctgaggtactgcgggttttgacttcagcatatgaatttgtcaggggcccagttgagcccataacacatccccattaacattctataggaataatactcctaagacaatggctttgagacgctgatcttgaggactatcaagacatcccacagttactctaaaagtgatctgcagagatttgaatgacccataactatctgaccatgtaaagccatcagtttctcttagaggtaattgccaaaaaaattaataggctctaataaccctccctcatcaagtttgtggtattcttctttaaaaaagttatttctgaaaaaataagcccttcaagatgatcctaaatgttatttaagaatagaatctaccacccaaatattcacaacaatgccagtatcttgtttggtattctatgattgtaaaagtcttcagcatatacttggttcattcagtcagaccttgtgattataactcaaaggatctctgagtcctgggttccctggaactatcagagacagagacagagagcgagagagacagagagagacagagagagagagggagggaagatgtcctgagttatgctctatgattaaagcaattattggattaactataaatccagctggataaattctgaaagaggaaaatccttttaacttccctttgcctctaatgaatctgcatatcttttattattttttccttgaactcatatttatctgccaagaataatgctgagaactggccacgcttgcaatcgttgaatggaaacacccccttctgaaaatccacgagactgattctccacaaaagccttctgtgtgaaataacagccagtcaatcagaaattattggtgaaagtaaaagttggtcatatgacttgactaggctacttactggtaggctagtgtcctgtgtgaattggtaggtagtggcatagttgggaaacacagcagtttcccttaccggaaattgtaagaagttttttgagaagaagaaccttttctattcacaagtgggatgaaagcaagttgaaaagtgtcaacttgtttctgcattcatgagatccataagaaccaacatagaagagtcgggggatggacaataagagcttgtattcattcaccttaagcaaccatgggcatagctaagtgttgtctgcctcactcgagtgggttattaagaacccagcaaaatagcaaagtgatccaaagaggtcaaaggacccagcattataccttaatcacctaccttcttaattgttctaaaagagtactcttggccaggcacggtggctcacatctgtaatcccagcactttgggaggccgaggtgggcagatcacgaggtcaagagttcaagaccatcctggcccacatggtgaaaccctgtctctactaaaaatacaaaaattagctggctgtggtggcacacgcctgtagtcccagctactatggagactgaggcaggagaatcgcttgaaccctggaggcagaggttgcagtgagctgagatcatgccactgcattccagcctggcgacagagcaagactccttctcaaaaaaaaaaaaaaaaaaaaagtactctttccacaagaatctaaatttttacaacagtttcctcttggtttcccaaagaacaagctcattaccttagtggtttagtgaaaaatccagactacttttatttttaaatgttacttactagcactattcacaatagcaaagacatagaactcaaatgcccatcagtgatagactggataaagaaaatgtggtacatgtacagcatggaatactatgcagccataaaaaggaattagatcatgtcctttgcagagaaatgaatgaagctggaagccatcatcctcagcaaactaacacaggaacagaaaactaaacactgcatgttctcactcataagtgggagctgaacaatgagaacacatggacacaaggagggaaacaacacacactggggcctgcagggagggtcggggagagagagcattagggtaaatagctaatgcatgccgggcttaatacctaggtgatgggttgataggtgccgcaaaccaccatggcacatgtttacctatgaagcaaacctgcactttctgcacttgtatcctggaatttaaaataattttttaaaaaatgttgcttactgacacattgatacaaggagctgtatttatgaatctgtattcctgatttctctataagttgaaaccagaaaacaagcctcaaagccttccaaaatcaggaaagccaatttatttgtatgcaatataatcacctaccatgtgaaatgcctggaattcagcattatacttttctggaggacataatgatgattgtataatgctactgaaattgttgaatgtagaactctcaaatcactcaataagtctctactatttaagcattcatttgaatccattgaatatgtatatcttttctttagcacatttgagtttatatgtaggattcatcgtgtggaaaaatagttaagcaaatagtttcttgttaatacctgaaataataacttcttgcatgtcaatggtttgaagcggtgcagaatataggaaaaaatgtacactatcgtcaatgttataaactggagacagacaaactgcatcaggtatgcattgttcgaatcaaagaaggcaaatgttgtaataagtagagtgcaatgttgtgtgttggagatagggaagacattatcagaatctgtagcctcagaaacgtcttctcaatcttctgttgtccagtttattcctcttgtctatgccatgaactgaagagtcatgataatttatcctccttcttctatgattagtaactcttcctttcagcttcaaagtgctctctctttctctttgtttcatacacatcctttattattttatattctcatgcattcattcagatactcatccactcatccatctgtcctgattccaattatccatctgtttacctaaaatttattaagcaccttctttgagctgggcattttattaaggactgcatagataaagagaaagtcatctattcaacagcagtgccaatgttgtaagcagtgggaattgtgcagcaaagcacaaccaaaaaaaacaaaatgaaaaaccaaattcctacacttatgagatttacatttgagtgggatgactagggtgatgttttcgacctctctgagttcaaaatcaacttggaactgagttttaaaagtctaggccgggcgcagtggctcacgcctgtaatcccagcactttgggaggccgaggcgggtggatcatgaggtcaggagatcgagatcattgtggctaacagggtgaaaccctgtctctactaaaaatacaaaacgttagccgggtgtggtggtgggcacctgtagtcccagctactcgggaggctgaggcaggagaatggtgtgaaccctggtggcagagcttgcagtgagccgagatcgcaccactgcactccagcctgggtgacagagtgagattctgtctcgaaaaaaacaaacaaacaaacaaacaaacaaaactatttgttttacatctctattgagtaccatcttaactctgaagcttagaatgcaaggctatttcagaattcagcagtctctatctgggctccacctccccctgccccctccccttcctcctcctcctcctccttcttcctcttcctcttcctcttcttcttctttttcttcttcttcctcttcttcttccttcttcttcttcttcttcttcttcctcctcctcctcttcctcttcctcttcttcctcttcttcttcttctaggacagtggtctctttatattgcccaggctggtcaccaactcctggcctcaagtaatcctcctgcctcagtctcccaaagtgctggaattgcaggcatgacccatcattcccagctctgtttggcccttattttatctttactctcctctccttgcctttcctctcctcttttcttctttgttctcatcctcctcctcctcttccttcccctcacctcttttttttatttctcctcctctttcacatcttccttcttctcctcctctttctcctcctccttattcatctttttcttctctctccttctctttctttctctttccctgtctcctctcttacccactttttctcaatttctgcatgatatgaagtgttcaaccatgttccacgctatgccgtaatactcctttgctttgcaaagtccatctcttctcacctggaatgtcttcctatttctagcaaacgtaagctccctttttctggaacccttgcttaactatctcaggcaaacttaggtctaccacagtgaacaaaaacaaatcccctgccctgggaaacgacatttgtatgggatttccctggtactgtagctcatttaagtgcctcagtaatacaactcaactaagctgcattggatttttttaaatgactgctgtcctcattatgctggaagactcttgaggacacaaacaaaactttcgtgttgattcacctgcatattctgaacacagcagttgttgaatacatatctgttagataaatgaacagatgggttgctgagatgatcttccaaagcaggttttcagtgggaacagggatcagaatatctgaccattggttgaatttagactgttgtcttggcatcatttggctggagaataaaagatggcttttaggtgcttttagaagaccagtgagtcaggttgatggtccaataggggcagtatccaaatcatagaaagaccttccaacaaagcttctgcaaccaaaagataagacactttctgagtgacaaagaccacctgattctgcaagtactctgcactgggtaaaacgtgcaccaggaagtagaaaaaataggggcaagggcaagtgcaacccagctagaaggcaatagctcttctggaggggaaaacagtcatgaatgagtcattagactaagtgagacccctagctcaagcatctactaactcagtaaacttagatcgggcatgtcacctctctgattcttagttttctcatctgtagaatgagaagaactctgcctaggattgtttagaagacaaaacttaaaagcatgtaaagtgctttgtaagctctgatgactctacacctaaaatcttagtttggggacattcagccaaagctgtaggtttgacttatgtatgagccccttctaacactgctatgaagaaatacctgagactgggtaatttataagggaaagaggtttaactgactcagttccacatggttgggaaggcctcgggaaacttacaatcatggtggaaggggaagcaaacatgtcctttttcacatggtggcagaagagataaatgagtgcccagtgaagctggaagccccttataaaaccatcagatattctgagaactaactcactatcatgagaccagcatgggggagccaccccataatctattcacctcccacaagttccctcccacaagttccctcccacaacatgtggggattatgggaactacaattcaagatgagatttaggtgggggcacaaccaaatcatatcaacttagtaccttgacagagatgaatatctgccgatgtacatcacaattattttgttttagtatatgaaagatatattatgttttggttatctcaatgctatgagtattgactgtgacttttcacacagtcatcatttcagaatgtcttcaagcagtttcaggaacagcagacatttaaaatcacttacccttttcccagttgctcaatgtttgacatccacatttatcataatagaacacaacatggttgctatggagattgatatgtttttcatgtttccatacagttaatggcattgtgtgtccaagaatgcacaaaatgctacccatggagtaaagcagatgtattttggtcttttctcccacaattccaaatgcaccttttacgatcctcttcacaggagagtgacaagggttggttgtactctagtgccaagtcttactctttattcttaccttctatttcactaagtgcaaaataaaatcaatgaggtactagtggaaacctcaagttagaccacagcctgatggctgattgcttctatttaaacaattttaagtagagacttactctgacacattaaaatgtaataattctaaattggatacactcgaaggtccttatcagaaatgaggatttgtgttatattttagtaacagaactagatttggatctagaagaattaggtctcacctctaactttctgctggtcacttaatctctctcagttgacatttctcatctttaacataggagggttggactaaatctacctacaagctcttcttactgtgagatttccattaagcctgtattttggacacttttaattcagaaagcatttgctaaataaaattgaagtgacaaaattccatttgcttcatagtgcaaattgcactgagtgcatggtctaatattgtttgtttgataattggctttaaaatgccttcttataaactgcacggtgtatgtgtgtatgaatattaactttatttgcagtccagtctagagccttagtattttaagaatcttaatcagaaatccaaacatatccaaaagtttatattccaaatatcctttttggaatcaacaacagagtgtccttatttatcataaggtgtactagaaataagtttttttggtgggtgacatggacagtgactatatatatggtaatatagtgtggcaggccgaataatgcctctaccaaagatgttcatatacgaattccctgaaactgtgaatatgtcacttgcacgacaaaaggctattctggtcccagatggaattaaaatagggagatttttaaaatagggagatcatcttggattatctaggtgggcccaatggaatcacagaatctttaaaagtggaagagaaagacaaataagtcagagtgataatggcatgaaacctgctattgctggctttgaagatggaaattggggccatgcctcaagaaatataggtggtctctagatgctagaaagaacaaggaaacattttctcccttagaacttccagaaggaatgaagccctgacaacaccttgatactaacacattgagagccatgctggatttcttcagaacatatgacaataactttgtgttgtcttaaaccactaagtgtgtgatgctctgttacattggccataaagaactaatacacataatttgtatgtgtctgagaatgtgggcagcccagcaccaagtagcttcaggccaatgttcatgttctatagtccagtgagtcccatgtagcccacccttcgtcaccctctacacttccaggggagacttttgtccaaagcaatcttaaacatgtataaatctgactttggaatatcattctttctatgtcaatgggtatcttttgtgaaaagctcctgtgtacggagactattcttgaggttatcacagtgtgtctgtaggctaataaatatttgttctgttggtggggttgatctccatggtaaagcatcccctagaaagccaagttctggggctggtcttatattgggagcctcctgatatggtccaaggaacctgggaactgatgaacagctaaattggcttaggtcaggtgagaaagtttaaaacaaaggaaagaaaagcctatagatttgactataattaattcaataattataaatgagcatgtttgttcattatagtcagcactatgggcaaatattttaagcatttaatttttcaatgagcattgtagaaattcatacttttcactaatttagactgaccttttccatcagttacccttaagtcattaatattatgctgtcattaatttgctagaatacaatcagcctagagtcaattctgaacatcacagaattagcgtggacatttaagtcattactgaaaatcaaactctcttttttgttgagtgataagtagccataatgtgcacattaattgggataagctaccctgagatgaaaggaagggggttaaatttatcatttaattataaagcaatcttctattttatcttctagatttaaactccttgactgcaagggctagatgtacttgcttgggtctctcccaaaatgcctgtcacagggcttgatcagccatgaatatatttaaattgcactcatcaaaagcacatgtagatgtctctgagagaattagggtgaaaaaatcgataaaataattaggcaggctattttttgtgggaagtaacagatgaatggggaattttcaatgctaacgaatcaaaatggggccgggcgcggtggctcacgcctgtaatccctgcactttgggaggccgaggcgggcggatcatgaggtcaggaaatcgagaccatcctggctaacacggtgaaaccccgtctctactacaaatacaaaaaattagccaggcgcctgtagtcccagctactcgggagactgaggcaagagaatggcatggagccgggagatggagcttgcagtgagccgagatcgcgccactgcactccagcctgggcgacatgagggagactccgtctcaacaacaacaacaaaaaaatcaaaatgaataagaaagttgtgttctgggtcagcattcgttccattcaaagtaggaatgaagaaaaatttggaaaatctgcccattgcggagcttacagtttagtgacacaggtgtccctgagatgtttttgtccagtgtgaaaatgtgggaattagaagtccttatacactcagtgttctggcgaatcatccttgctgctcctagatttgacttatgtctaatgttaaactccctttctatgtctgggcagccaagataatttaattttaatgttttcaaaagaaatggctttgattctgagaggtaaagagaaatatacaagcaaaagggtttttaaaaacatacgaagcattgaaatctcaattattagattcaattctatgtaatgagaatattagatattgtaaatttaattatgtgaaatgaacatagaaaaaacaaacttaaaagcaaacaagccaagaaatgtttaacattcatttccaaaaattactgaatcatgggtgaactgcactttctgcttttttgatcttttcagtatctttttatagagagcttacactgtcaaagaaaaaataatagtttaaaaattattttaaatcgataaacatataatttaagttgtccatttcattatataaataactaatagaacctatgttatttgctgagatttcacacattttccacaacttttcatgacacatacaaaactttgatattgatctaaatatcagtctttaatttgagaaatacatgtttcctctcaaatacctgtggtttacgattttactaatcagcagggtaatatggtattctgggaaattgtataggacttgcttttatgttcacacataagatgaaattcagataatcacaggtattgaaaataaacactttgcaagtgcttggatgagctgaattcaatttaaaaagaaaactagcactttgcctaaacacatataattgtatgtacttaaatcattatatactaatttggattaaaagaaggtgtcataacttcaaattcaatatgaagatcacagcgtattataacaattcactgtctctgtgggtcttttagctcttggctttctctcccgaagaaactcgtgcaatgagctgggcaatcttaccttgcaaacacacatcacaccatcaaaataactggtcttaaaggaaaaaggaagcttgcaagtattacatgttctcccaaaatgttttgtaaaataaatagatggagcaatcttttcaatgataaacatgatcattattcagatatttaagatccagacatttttctttatagagtgacttactctgaaatgtaccctgggtccttcaatcattctccagagacagtgtccaatgcagacaatagataattggctctctcacttcctaactgtgtgacatttcatctcttgagctctatgattatgtttccctataaacaaaatggaggaggagatgattcataaagatgaatttatttactgatcaaacacatatgcttttattaggttggtccaaaagtcactgcgatttttgccactgaaagtaaaggcaagaactgcaatggctattgaactaggtgccgtatcatgctcagggattataaagatgagtattggctccttttattgtgctcaagcctcactgttcgttatcaaacctacatgtataaatcaactctgtactgaatgtgagaggtagaggctttgtgcaacaagacttgaccgcctcctggttttgtgtagatctcactagaatataagtagcttcagggcaaggatttctctctgttttgtgctcatttgtatccacaacgacagaagtgcttggaatacagttcaagaaaagtttgctgaatcagcaaatggccaatgctttccagtgggattttctacaatcatagaaatcagtgttgcccaatatggtagcagctagccacatatggctattgagcgattttattgtggcagatgtaaacaattgtattagttcattcttacactgctatgaggaaatacccaagacagggtaatttataaatgaaagaagtttaattgactcagttctgcaaggctggggaggcctcaggaaactttcagtcatggtggaaggggaaggaaatacgtccttcttcacgtggcagcagtaaggagaagaatgggagcacagtgaaggggaagccccttataaaaccatcagatctcgtgaaaacttactatcatgagaacagcatggaggaaactgcccccatgattcaattacctcccactgggcccctcccacaacatgtggggattatgggaactacaattcaagatgagatttgggtggggacatagccaaaccatatcaacaagtaaccagtttttaaatttaattgaagaaaacaaatttaaatggccacaggaagctgttggttaccttaatagacagcacagggctcatgttttcatttggtgttttctaaaaggatgaaatactagttttatttttggtgactagcctaggtgcacttaattttctcttacaaactcataaaataacaaaactaggaaaggaatgaccccaagtttgctttaatattctccatttatggtgtattttttatacagaaattttgattagtggtttcctttgtgacttatctatactttcatcgttagaaagaccttcccactccaagattataaattctcccatccttccttctagtatatttaatacaagcatagcttcattgtttatatttaaatcattgatctatttagaattgatccgtgaatatattgtgggacatggatctagatttttctttttctttttcatctttttttagagatggggtcttgttctgctgcccaggagagagtggagtggggtgatcacagctcactgtagcctcaaactcctgaggtcaagtgatcctcttgcctgagccttccaaacagctgggaccacaggtatatgcctatcatgacctaataattatttttatttttgtagaagtgagatcttgcttcgttgcccaggttggtattgaccttctggcttcaaaggatcctccctcctaagtccctcccttcccagatttaaatttttccataaggctaaccaagtgttccaatctgtttgttgaaatttatcttttcccaaagattgacatgccagctattcatgtccggaattcctatatacattttacctattctggactctttggtctgttccattggtttgtctctatgtctgcttaccaatgccatgttactttaatcattgaggatttataatatgctacaagactatttcaatgacttttaaccatcctcttcattgtttttattttccaaaggcttcctagttattctttgttcatttttctaatatggtcttccaattagtggttgtttattatatatgtgaccatcatttgtttttatatattattttgtattccctactgaatttccaaatggcaaaccaggagaaacattgtgattcatatcacaagcaaaggactgaactccttcctctaggagcggctcctaggaggtgattattaaaagatcaacaagcgatagatagcaaacgggcaaagggtatgcatggacagttcctagaaaaaaaaaaaagaattcggccaggcatagtggctcaagcctgtaattccagcatttggggaggcagaagtgggtggattgcttgagcctaggcattcaagaccaacctgggcaacacagcaaaaccccatctctacaaaaaatacaaaaattagctgggcatgatggctcatgcctgtagtcccaggtactcagaaggctgaggtgagaggatcgcttgagaccaggagatggaggctgcagtgagctatgatgacaccactgcattccaacctaagcgtcagagtgagaccctttctcagaaaaaaaaaaaaaaaaaaaaaaaaaggaattcaaatggcttttgaaaaagggaagatatgcatgttaaaataatacaattattatgtaagcaaattacaagttcactgaaatattttaaaatgtattacatgaggaggagaaagaggtaggcaagaaaaaggaagaggtggaagaggaggaagaaagggaggagaatgagcaaatattggttacagccaaattataactcagagtacactagttccttcttgtgtctattcacggggagggtcgtcttcatttctttacctgtatccagcttcccagtacaaaataaacgcctgtgattaggttcaggaagcatactctgtgagtatttgcaagagcctgggtgctggcttctcagatgcaaacactgcagtccctctatgaggcaattgctgataaggtgaagtcactttgagaccacttttgctgactgacttaccatattccgaatcacttgttggtgctgtctctctccctttgatggaaaaagagaaaccagcctgttttatgtggaaagtttccatgtgtcttagcaacttctcactctcaagttgactgtgagtcgttttcctgtttgtctcatctctgccagtgcacggagctcacaggagcagctgaagcaaggagaataatgagagaacagactgtcccgaaagagacaatttgggaatatctcaccataaggagggaagctaagagttgggagaaaacttaggctgatggatacaaggagaacctgactttgcccaccaagagttttgacaaaaacaaatagtagtaacaaataataataataataataataataatagcagataagtggtgtgggaagcatgatcctgataccctcaacatccttctgtggctgactgtggctttgacttgaaagagaaagcacattgaagcatcatatgcccaagccacaggagcaggtttattctagacctgctcttcaatatggtggcgagtcaacacaggtggtcattgagtgcttcaaatggggcaagtctaaatatggatagattgcaagtatcacatacacacctgatttcaaaatatgttaataggtaaaatatttccttgatatttttaactattgattacctatgttgaaataataatattttagatataaagttgactgttaaacaacatggggtttaggggtgcccacccctgagccattgaaaatatgcgtataactttggactcactcaaaaattaacaactaatagcctactattagccttatcagtaacataaatagtggattaacacatatattgtatgttatatgtattatatactgtattcttacaataaagtaagctagagaaaagaaaatgttgttaagaaaatcataaggaaaagaaaatatatttgctattcattaagtggaagtggatcaccataaaggcctttatcctccttgtcttcacgttgagtaggctgaggaggagaaggaagaggaaaggctggccttgctgtctcaagggtaacagaggaagaataaactctatatgtaagtgaacccacacaattcagacctgtgttgttcaagggacaattttattgagttaaggaaaatatgttattcaagtcaatttcacctatcctatctacattgttttaaggcatgctactagaaaattcaaaatgacacatgtggtttgcacatatttctgttggattatgctattgtaaattgtccacatcaataaacttaggctgggtgcagtggctcacacctgtaatctcggcactttgggaggctgaggcacgagaatctcatgagcccaggatttggggaccagcctggacaacacagcgggacctcatctgcacaaatgtatcgtgtgcacctgtagcactagctacatggggggctgaggtgggaggatttcttgagcccgggtattcgaggcctcagtgagttgtggacaacagagtgagatcctgtcttttgaaaataaaaaaaaaatgaatacaagagcaaaaacatggaaagagctgagctctctctttagctaagttactgtggactttgcctaggcaggtgacatgtgcgtcacatgatgcaggacatggcttgcatctccttgggccctcattaacccatccctaactctatcccctgagcatcgcgtctccatctcttacctccttcttaaccccctttctttgttttctcataatgtaaacattgtcctgcattcattagatgtaaaccttacaaaaatcacttgctgtttttttttccctttccatataaaacagtcccctttctccttgattttgtgtctgggacatgctttcatccactacagcattgttccgtcttagagtgggagaagtcatgttccaacatcactcctcccttctctattcagaagacttaatcccaacacaaactctcccctctccaaacacatattcctcagaaagaccttctggccatggagagaactataggaccgtagaagtgaggaaacattgccagatttttccctttgttatggaaggtcccagttcaacaaggtcttctttccccaaataaaattacgcctgaaacacagaagccagttatttaatactttggtagacttgtcatggaaccatgacaataagacttaaatatgtatatataaaaatatgtatatataaatatgtatatgtatatatgtatctataaatatgtatatgtatatataaatatgtatatatgtgtatatatattagatctagtaaacttagaagtgactcaaaacaatggtttttaacatttccacttatctgcccttccatttaaagctctacctcaccagaccagatcttgcataaatgcacatcttttaaacagtaccttcaaagaaatttattttgcaccctcactgatgagagtgttttaatcagttgaaatgtaggtcataacttaaacttccaatctagaaaatgcctgtttgacatagaaagttattttgagatgttggttgctaaacaccagtctttaaaatataattaacttggctgggtgcagtggctcacacctgtaatcacagcattttgggaggccaaggtgggtggattgcctgagctcaggactttgagatcagcttaggcgacatggtgaaacccagtctctacttaaaatacaaaaattagctgagtatggtggcaggtatctgtaatcccagctactggggaggctgagacacaagaattgcttgaacctaggaggtggaggttgcagtgagctgagattgtgccacttcactccagcatgggcaacagagcaagactctgtctccaaaaaacaaacaaacaaacaaaacataattaacttgcacaaatgatagatccctgagaaagaggctacttgcaaagggtatccgaagggtatcagagtgcagattctaaaactttgtaaatcacagttgagattatcaatgaaagtttgtcccctccttgctaaggaaaggtgaggaggacacagtatgtcttactttaggattccctctggggtaggctgaataatggcccccaaagttctccatgtcctaatccccagaacctgtaaatatgtgaccttgcatggcaaaatgaactttgcagatgtggttaggttaaggacattgagaaggcaagattgtcctggattatgcagatgggttgttataaaagggatgcagtggggtcagaggcaaagaaaaagatgagacagcaacaacaacaatgacaacagacgctagagtgacacagggccatgagctagaggatgtgaacaccttctagaagctagagaaagcaaagagctgactgcttcctacagcctccataagaaatcagcctgctggggggaatgcaatttagttcagccagcagtttagagacttcttcaagaacttacatcagaattaccattcaacccagcaaacccattaccaggtatctacccaaaggaaaataaatcattttaccaaaaagacacatgcacttgcgtgttcagcacagcagtattcacaatagcaaagacatggaatcaacctatgtgcccatcaatgatggactgcataaagaaaatgtggtacatatacatcatgaagtactatgcagtcatataaaaagaacaaaattatgtcctttgcagcaacatggatgcagctgaaggccattatgctaagtgaactaattcagaaacagaaaaacaaataccatgttgatatggtttggctgtgtctccaaccaaatctcatcctgaattgtagctcccataatccccacatatcatgggaaggaccctgtgggaggtaactgaattatgggggtgggttttttcttgtgctgttctcatgactgtaagtctcatgagatctgtgcagttgccctgcagagatctcatgagcatgcagttcccctgcacactatctcttgcctgccgccatgtaagatgtgcctttgctcctcctttaccttccaccatgattgtgaggcctcccagccatgtggaactgtgagtccattaaacctctttttctttataaattacccagtctcaggtatttctttatatcagtatgcaaatggaccaatacacatgttctcatttataagtgggagctaaacaacagatacacatggacataaagattgggacaatagacactggggttttgaatggtgggaggaagaggaggcaagtgttgaaaaacttcatgttaggtgggcacaatattcactacctgagcaatgggatcattagaagcccaaacctcagcatcacacaatataccctagtaacaaacctgcacatgtgttccctaaatccaaaataaaagttgaaattaaaaacaaatcagccatgccaacagtgtgattttaggacttctgacctccaattctataagagaataagtttgtcttattttaagtcactgtgtttgtaatactttttataccagcaaaagaaaacaaatataccttctcacatccagaacttttgttaactcttcattttccctcatctgatagactctcaccttttcttattttccccttctgtaaggacagttggctgaagctagcttgaactggttcatggaaaccaactggggtcatctcctcccatctccaaattcaataacaacattttgcaacttggattcagacatgataggaatatttacatcatggaaattggaaaatgctccaaattagcacctcaagacactccttcatgagacttcaattttctttaaaattcaccaatcattcccactttcttggataataggtttggaaaaaatcaggaaattttgccttggagtccttgccctaggttcaatgatttttattataatgcagatatatctggttgaatattgacttgatataacacctaaaatgtacttaatagtaacaggtgtatgtaaaatattttaaagcattgacataaactagaattagagtaatcttaggaaatatttacaggtagaatagatgggaagaacagaatataaagtagacattaagaaagaaggcagacttggttgtagaacaattgacggtctatatgtgcagaaatacagaagcgaatacaaggaagataacggtttaaagcgatttggaaagaagaattagtactagatgatagcagatctttccacttcagtataagccttctatatgtattgaatataggaataacacatacaaaccacacagtaccttattagtataattcaaaataactgatttcgcatgcgtgaaaacgaaatgtcactacttatacaaatctatgccgtgatgttgacattcgagactgcaggaaaactggagtcattgaaggatacctttgcaccaaatctgatcaggggtaggtaattttttgcctcgaagtcttcccttgggtgcatcttgaatacctcttctctctcttctgtagtgattgatgtatcctctttgggacttggtgtatctttacacttttccatcttgccaattttacacattggcagtgagaatttctgctgttggcatcttcagcagaatctcagtccttttgtacttccacacaaggctatttttactttcagtcttattcttaatcactcctgctgtgtcagaaacgcaggcaatatagggctagtaaatcctcagtaactgcctctccagaggacttggggtggaggtttgatttgcaatgtttgtcaatttctacggtgtagatactcccactgagactgatttcaagtgatcagtgtgatgtcgttgaatgtgtagttgggaggagatgaactcgacaagttccccccaaaatttggtgttgaatgtaaagcaactctgagcaccattgactgaagtcaaaccacatagacaaagcctgttcatgaagtcaactaaaacaattcaacaacaaataaacaaattaccccatgaaaaattgggcaagagggcatgagtagacattttttaaaagaagacatacaaaagccaatgagtctatgaaaaatcttcatcatctcaaatcatcagagaccacaatcatcaccattgtggtccaagtcaaaaccacaacgagatatcatcttttgccagtcagaatggctgtaattaaaaactcagaaaatagcagatgttggtgaggatgtgaagaaaagggaatgcttatacactgttggtgggaatgtaaattagtagaacctcaatggaaaactgtggagatttctcaaataactaaaaatagaactaccattgattcaacaatgccactactgggtatctacccaaaggaaaagaaattgttgtataaaaaagatacctgcacttgtacatttattgcagcacaactcacaataggaaagatataatatcaacccaggttcccatcaatggtggactggattaagaaaatgtggtataatacaccatgcaatattacgcagccataaaaagaagaaaatcatgtcttttgcagcaacatggatggaactggaggccattatcttaagtgaagtaactcagaaaggaaaattaaatgctgcatattctcactcacaagtggaagctaaataatgtacacatggacaaagagagtggaataatagaaattggaggcttatgaagggattgagggatgagaaatttcttaataggtataaagtacactatttagttgatggctacactaaaagccaggcttcattactgtgcaagatatctatgtaacagaattgcacatgtaccccctaaatacatactttaaaaaagaaagaataactatcttgataaaaagggaaatctaggaagcttccataatccatattgtaactccagtaaagttataactgtgaggtcctgcgttgggtgtcccaatacaaaatctgtaaaaaaaaaaaaaattaaataaaatgaagttgtcagagcacagaattgtgcatgtgggaaagatactaggtttcaaatctgggagtgtacacccaccagcattgattctcatgagatttacagctttcctcatgccaagaagtcattggcacttgcaatcatacaaatgaggagaatgaaaggattgtggaaataccgacagccttatagcagtctactaaatatagagctctgcagaggcagaagagagataattcatgcattagagtaaatccaactaaactttctttgaactgatcagagcatccatgggaaacaacagggctgaaaaacatgcagcttttctcctttagggaaaaatttggcctcagatgagcatttatgtttgttgtaaaaagcggggaaaattatgcatgtattaaagaatagatatttttgtaataccacaccccagctagaatagtgctgttcagtgaaagttcgtatttcccaaaacacagccgtgaagccagaaaagccaatatctcagtaagatgcttctatctgaaaaaaaaaaaaaaaaaatctgcaaaaggctaaagaaactatcctaagatggtatgtttttatgcaatattttatttttgaaggattagctaacctacctctttctcttaccgattttttagatagaaacattggctttaagggaacagccatgtaacagattcaagggagcacttgtctggttggctttaatttctagaagatcacacccatccatgacaatacgctttgtatttctgaggaaggattttcctcatggaactaaaaatgtacagcaggaaatggatagaaagtcagaggacattcagtgttgcaaaaggacttggtcctgctctctgattctggggaaaaaaacaaaaacaaacaaacaaacaaaaaaacaacttagggagatgacatggccctagagaggtttggctgcaagttgtgcccaggtgaagagggccatgggtggcctctcatttcctgacattcaacacaaatcagaactggaaaccacagcaggacaaagcaaatctcatctccttacatggaccaaagtcaaagtccagattcattgccgcagaagctgaagaccagaaagtaccactgcctctctgtggaagattttgcattttacaagcaccccagggcaaactgtgggcagtggttggtttgctaaatgaactgggatgatattttctccatttcactttaactagaaaattagagtttaaaaagtatagttgtatttcttagatgccaatgtttaaagactgagcttcgcgctaatgacattcagagatggccatcaaataggtgacctaagaaaccctggatggaaactcatgcataattgtgttttacactaatttgcatggaaattttgattaatgcaaccaaaaagttaagtccaccatctagattcaatattaaggtaatcacatccaaaggagagagacagtattaaagggaaacaggtggaataaaaactaaattaacaaacaaggaagctgatggaaagttacgtcacttgccagagaagacagggtctatactctatacaaaaggtcaacctgaagcaaagctgtgctccaagggaattgtgtcttaggtagtatccccattattctctacttggtacttttttctctttaactggtaagaaatgatttctcatttaagagcatccaaaaacccacttttgtctatgagccatgcaggattccagctccagggcatccaggcttggctggtttccagtctggggcctgcttttgatctttcgacacatattcttggcattctaaactcttctacgtcaacacccatataaacagattcaagacagcatctttcttgttggttttaatttctagaccaaactcattaaagacaatacatttggtgtttctgaggaggggatttcctcagggggctaaaagtgtgtgatggaaactcaatagaggggcagaggacattcaagaagatactgtcaattaatttctgcccctgttcttagggttctaaacctttctcagccttgtgccccaaatgcccaagaataactggtttaaagcactgattcaatctttcctgcaacacagttaatgggtggtaacgatgattgtgactaatttaaagaaaatactgacttgcaaacagacacctcaaatgctttaaactatgatttcttaactccagtaccaatgacattgggtgtggatgattcttgcgaagagaagggacagtcctgtttatcatagaatatttatcagcttatctagcttctacccactagattccagtaggattcaccagcttcccaggctgcaaccaccaaaaatggtctctaactctgctaaatgtcatcttgagagcaaaattgctcccatggatagccatggatttatttaatttcaaaactactgacagtaggcagggttgaaatcagggtcatgctgaataagagaaaagacgatcactacaaaaagaaaaccaagcaaaaacaaaagttaccagcatagatacacctaaggcctttttttttttttctatgaattttggcaaggtatgttagcactgcatttttgggaccagtagccaagggaacttcttgagaaatgcagacctccaatgaaccctgccggtaacacatctgatatggtttggctctgtatccccacccaaatctcacctcgaattgtcataatccccacgtgtcaagggtggggccaggtggacataattgaattatggaggcggttcccccatagtgttctcctgatagtgaatgagtgctcaggagctatgatggttttataagcatctggcatttcccctgctggtacattctctcttgcctgccgtgatctaagatgaaacttctgccttcctccctgactgtgaggcctccccagccacgtggaactgtaagtccattaaacctctttcttttgtaaattgcccaatctcaggtatgtctttatcagcagcgtgaaaacggactaatacaacatcaatggggatggacattacaatgacccccactgcattgaacagaccttctatgaggctcaggtttgttttcagatgagttaaaaacccgttatgaaaaatgtcaccataataaatgatgccttccttttgtttaaaacgttagtgaaaaatttatttatcaaagttacttgcttggataaataaatttctattcgaagacattaaaagaaacaacaacaacaaaacctagttagcatagttaacttagtaagagctggggaaataatacctttaaaaagttaatgtttgggccaggcacggtggctcacacctgtaatcccagcattttggtaggccaaggcagacagatcacttgaggtcaggagttcgagaccagcctggccaacctggcgaaactccgtctctactaaaaatacaaaaattagccggttgtggtgtctcgcacctgtaatctcagccactggggaggctgaggcacgagaattgcttgaacccaggaggcagaggttgtagtgagccaagatcgtaccactgcactccagcctgagcaatagagtcagactctgtctcaaaattttaaaaaagttaatatgtggagttgggaacaatggattctgaaggtagatcacattctgtcttgaatgcagtaggtagacatatttttttaactgtggagatgttttatttccttcccacgcttttaacattctttgtattctgtactgaagatcaagaactaaacattccacttttatgtttctcccatggggtacttttaaattaagttggtctctggctattatatttattttaatcttttgagtttgtttttcccaacaataaagcctgcagtttactaatgtactgtcagatgatgttgaatacgcaggagacagagccattttctgtctcagtaaacagatttttctcaaaccaaaagctagagattaggtcaataagcttttatggcaacttgttagatttttcttaggaaatcataaagatttttctttctagctcattttcaaattatatgaaatgatcagaactaaaaataaagaattttagaactaatattttataaaattaggatcgtaaaaccaagatccaaactgatttttaaaaatgtatatacccagtgtcttaggtcaagttttctagaagagcctggagaagggttcttgtgcattagattttttcagtaataataatactaatatttattaaagcctttgtatgtgctagacataatgctaaacacctcacatgtattatttcatttaattttcaaaataatcctataaagcaggttttattatatattttttcagatttagggggtacatctgcttgtttgttatatgagtatattgcataatggtggggattcagcttctagcatacccattgcccaaatagtgaacattgtacccaataggtaattttccaaacctcacgcccctccctcttccattttggagtctccagtgtttattatctccatttttatgcccatgtatgcccactgtttagctctcacttataagtgagaacatacagtatttggttttctgtttctgagttaatggacttaggacaatggctcccagcttcatccatattgcagttaaagacttgattttattttatttttgtagttcgtttttctttccttctttctttctttctttctttctttctttctttctttctttctttctttctttctttctttcttcctttctctctttctttcttttattattttttttttggctgccctgaagggcagacaggtttattggtcagcagccgggaaaatcagtggttgggcttggccacatgctgcagctcttccttcttcttgatggcataggagttagaggagccctaggtggcattgatgagcttatctgccagacactcagcaatggtcttgatgttccggaagggagcctcacaagtgcctgtgcacagcagccagatggcctgattcacatggcgcagtggggacacgtccacagcctgtcgtctcacagtcctggctcgcccaatgcgtgtggagccctcccagggaccactgttgatgatgcaccaggacttgcagagggttcttgcctgtgagcaggtgtatgatctcgaaggcatacttgacgatgcgcacagtcatgaacttcttgcagttgttgcggccatgcatcatcatggagttagtgaggggctccacaattgggcactgagctttgtggaagcgtttgggggcataccaccctgaactgtgaggcaggtacttggcatacttctccgtcactgcaatgtaatcctgcagggaaatgtcattgatctgcacatcatcagtgctccacttcccaaaaagcttgatgtcaagggtctgtgccaccgctggtgctgctgtctcccactcggtcatcctgagagcatagcctgagaatctctgtcgctcggcgtggaccacgcgccgccttggcacagaaagacagagcggctgtgtagttttctattatgtatatgcaccacattttctttacccagtaaatcatcaatggacatgagtttctgaaggagacctctcaggagaagggcaggacagcaggctagggacaggagagcagagagctagactggatatggtcccacctggagctgtatttcaacttgcacttcaaatttagtcccatcttgaggcaaaatagctgacctatgttctccagggcatgcaaaatcgctgcatccagatgatgcccatgaaggattttaatagtgatgaaaagtggttatgacgtgtgttaagtgaatcagagactagacaggaatctaccaccaacacagtcttaaccatgcactaaagtttacttaaccaagactaaagagagttatacaaaagtattattcgtggttatctctggaagatgaaagatctctagaagatgaaaggtggtcattttctttaatttttaaaataaatttccaaagtttttacagtggacttagtgtagtgaacaagaacacgttcactacactagaccaagaacacctagtatgtgttcaaaatcttgtttagcaacccaagtaaggtatgactgaacaatttactttccatcctttaaaagggggttgataaattttgacccatgaccaaatccaactgaccatctgttttgtaaataaagttttattggaactcctcatctatgactgcttttgtacagtagcagaacggaatagtttccactctgataggtttaaaagacagcatgtgggtgaagaaatcactcaactcttacaatactattgtcacttccacagctcactttattttccatcagaagcacaactagtccttgcaggctcttattacaaagaaagaaaattagactcagtaattaaagtgaattgcctaagtccccataactatctcaaagcatgtggaaccagacatatgtgtgattctcaatacacaacctttacaatcaattcgttgcttccaagaaatcagtaactatctattttcaggtatatcccaggtttccagagtggaagtagggagtagaaaaggttgcatataaaggttcattaggttttagtagtattatatttttcatacggggctagtttgctcaagtacttttgatcatttgtggacaatgcagttaaggtaaatcctaccaggggattatgtaaatttaatgtttgaatgcatttcttttgcatattggaagctcatataactttttgtgtagcatattagtgcaggaattcttttactagaagtaagaacgtaaagcttaccagaattcattattttcattcctcaagatgagaaatattgtgcttttggattctattacataattctgtgctttggagcaaagacaatctgtaacagacattttattccacctgtttttgctatatttactgtagtcctatagatgtaggctagagaaaaaagttaaagtagctgaataaaatatactttccatgtcgttttttggggggaatccttaagaatgaaatgtaagtagttttgtaagtatatgaaaggcaacctctcagtgctgtttctctgtgttctttcaaacagctattatcttctcaaatacctcagcatgaatgatagaactcaggaatggtaaatatgatggcttaggctgcaccagaagaaggacagagcagggtcgtgatccattctgaaatgcatggcagatgatatttagaaacaggctgtctggggccaggtacagtgactcacacctgtaattctagcattttgggaggccaaggcaggaagattgcttgagccctggagttcaagattagcctgggcaagttgtaacaagacctcgtgtctacaaaaaaaaattttaaagaaaccagccagacatggtggtctacaccttcagtcctagctactcaggaaactggggcaggaggatcccttgagccagggagtttgaggctgcagtgagctgtcattagaccactgtactccagcttgggtgacagagaccctgtctttagggaaaaaaaaagtattttaaaattaagaaatagaaataagctctttgcaaatagtaaatgagtttcttccatatgtaaagtgccctgctaagaaatgtgtaaataagacacagtctccgtattatgagctgaatactttttgtagaagaaatacgtgttttaggcgaatacttatagtacagggaacaggcaatgcagtcaatgtgttcaacaataaacgattaattatttcctatttaccaggtgttttactggaaagacaaatggagtactcttcactctctgctgcttcgtattacaaataatctgccttaagagcattgctaaagtagaaaaattaaccaaaacacaattggatgatttttttcactggtgatgggaagaagatcaggggttgggatcgaccaaccagttcccagtatcatattggtttctactttatcctccagctcttgaagttagaggtgacgaaaaaactgaagaccacaagccacatcaacgacttgggtgaatgagctaccacagaccactgtccacacattcagaatatcttgcaagattccattcctgtctccacctttcactgggtgagtgatggatgtagaaagccaggctaatgatggtaaagatgtgtacctgccacaggatagttctgtgtttggggtggtgcccatggttgagctaggacagtaggcagcctcttctttgcattggccatttcatccctataaatagttttgcttggggtacctgaattcaactgtgccaggtcatttaaggctaacagtgaggcaggatatttccctgaccccttcatgggtgggaactggagtgcatgggtgctggcaggggtgaactccactcattcactgctccaccccttgtgggagggggagtgcaggtgaggggatgcaggagccagggtgagtgcttttgggtactagcaacagtgaactccatgctggccccatggctgcctctagggtaggttgcctgtgactcctaaagcactaggggaagtgttacagtggccttttagctttgcaacctgcagacggcttaagtgttaacagctcagtggagggtcagtgtgacagccttttgtactgacactcatggcacccaagttcttgtccagcgtccaggaggaatgaggttgcactaacgaactgaagatggtaaatgcaggggatttttttattgctggtgaaagtggctctcagtaggaaagggagctgaaaaggggatggagcacaaaggtaagcttcccctggagtcaagctgttcctctgaagtcaagctgcttctctccaatgtccaactgtagtctctcacatccagctgcttctcctctctgctggctgagcctggggtttttatgggcacaggatgggaaggtggggtgggccatgggtggttttggagaaggcaaaattcgagggggaaaagaagggtgtaagttctctctttgggccatggttccaggctttttggtttgagggtggggacttcactggggaccctcccttttctgcccagaatttccctgccttctatttctatcaacagtataggaatgagtcatactacttggactgtggttctccaacaagttctacaccagggataagagttaagatagataaaaatgttaaaggtgagagaaagtctgtctagcctgggctgagccgaatcatgcagatttagtaaagccttaatacccaggcttcgggcttcattcttaaggctctgaacctgagttggaagaaagactcttccctcaacatgaggtcatcattcccaaaagaaagcctaggacattgtgattgaccgaacctaacgctctaagaattagtggctaccagtttgctcattcttgtagtctcattaccctaagtcgaaagaaaagtgtctcaacaatgaaaagaagaggaccttattttcaggaacttaatggtccaataggaccataaggacaacacaacatgcatttcatagaagcttggagaaaagtattctgtactctgactacagaaaattagtaaagtctattgagataagaattttgatcaggtccccctgatgacgcatgagctcagtaactagattgtgggaaacaaggtttccaggagaaggtcacattgaaggtcaaagatccagggcattttatagcttattctctaagccctaagatgtgttgttcatctgaaacatataatatatgatagaaagtaatggaatctaagtctagtaggataactggatgacagctctgctaatgagtgcagaggaagtcttgctggtctttatttttgggaatccttaagaatgaaatgcagttctgtaagaacatgaaaggcaatctcttagcgctgtttctatgtgttctttcaaacagctgttatccccctcaatgaggttaaggaaaacaacacaaaaaaagagaaaatgtagcatagttcttgaaaatggcctgtaggctgggcatggtggctcatgcctgtaatcccagcattttgggaggctgaggttggtggattgcttgggcccaggaatttgagaccagcctgggcaacatagtgcaatcctgtatctacaaaaaaaaaaattagctgattatgggggtgcatgccagtagtcccgggtacttgagaggctgaggtgggagtataatctgatcctgggaggtcaaagctgcagtgagccatgatggtgtcactggacttcagcctgggcaacacagcgagactgtctctcaaaaaaaaatggcctgtaactaaaattcacattataaaattgttgagtattttggagctcacccataactggatttagtaaggaaaatgaatatcagtagtggttttacaatttttggtgctatggacccagttaatgtatttcatggatagtttaatattccttcaagagaaaaccccacatacacacaggagacacatcatagggactccaattacattatggacccaggttaaaaatctaattttattgtttaagatgagaaaagtaatttctgctggggtggttccttctgggacatgccccatttgccattgagaaatgggaaagagttgaagaggaagcaaaaatgtaatatgtctttcttaatgtgggtctcagcagagtgggctacccagaaatgattgtattctatgcagagtgaggccagcgtatgccagtgtcctctgtggaactcatatgtgaaatcctgtgctgtaagttttcacgtgtgtcatctcctttcaatcccagcacactatctaacatagttaccaccacactcactctaaggatgaagataccacacttgagtaacttccctgaagatcacagagctagctaacagtggagataggattcaaactttactatctacaagcaggatgtttttcactggactgctttaactcatcttctcctcttctgatactttaagaaaggagtgacaaaactgtagatgtaagcccacttaaagaagccccaaaattagtgttgctcagacaagcacacggggtaaactcaagttgtgatggctgcaagcaccaagtgttccttatagataaaggaaatatgtcttgtttaactagcttgggagactttttcaatgtagccatgaaatacaaagcaaaaggtcgaatttacaggtatatttacagatatgtaaatttacagatattacagatatctgagttgcctaatacagaatataagagaatgatgtacatcagatgattgtccaatgagaaaagtgtcttcctatgcttgtattaggaattgtgcactgaaataatgcatagaaatagttatcagtttctgatggctgtgtgcgatcaatctccagtggggtttctcagtccatcaaactcttgatttctcagtttagctgtgatcccttcttcatccaataagtgcagtatacatttgcagaatgctggtggtttctaccagtccacagtttagaaaataatactgccagtaagacaatgagtcgtcttatccccttgagtctttgaccaccgtgagcatttcaaccaaaattaattcaataaataattatcgcacagctacaatgtgctgagctgtgttctggatactgtggaatacacaaagatggtcagacacagatagatccttaagatggttatagaagggggaagccaagtttaagaaatgcacccaaatgattatcacaaaagcaaggtgatgtatcagttaggagccaaccaggaacagaggcaattgtaccactgattgtaccatagagggaaatggatagaagggatttataacacaagtgctgtcaacgtgaacagagtgagggaattcagagcccagtaacagtggaaagctgacaccaacactatacctgatggtcaaacggagaaggcgatgttaataaactcaatggaggctgcaacagtaaaaagagcaggattttgagccatgcatggagaaggtacattataagaggggtgagaaatattctggatttcccctttttcccatcagcgaatctcctgctggtgcattctagcaggaagcctggtgacatgaatctttgaaaatagtgtctgcatggcttaggctccctatgatgcaaaacagagctggagaatggggaggaggggatctggggtgaggcactccaaggcgtgcaaagacactaagtgataaactaatccaacattatggagattcaaagaatccagtaatttagacaaaattgagagaaaggattccaggatcctagattgtggagagctttgtgtacttgagaaggtcaatttagaaatgtttcatacgttttaaggaaattaaaagcatctagaaatatgcttcatttttctcctttactccctgttcaggaaataggagagcaaacatcttgagcatgtatcttcaggataattttcaatcagagatacatttaccatctgaaatgtttatccgctacttgctttccctgcttttgtctttagctttaggtcgtcgtcatgtgttgttcttcctgatacagggaaacaataacaaagataaagcagacaaatgagcttcctggctggttttatctgacttttactcaaggcttctctcccaagatgtccagttacttaggctctaggctgaatctgcatagtggcattttggtctttataatttttccagctgggagagatctattttaagtaataatcataataatctggcttggttttatggtcagttttccctatctgagcaactcggaaggtttcggatgatttccatcaagtgaaaacttcttgagaagaaaaatgtgtatgaactctggatgagggtttgtcaacttttttctggaaagggctggatagcaagtgtttttggctttgtgggacatagtttctgccacaatgactccactatgctgttgtagtgtgaatgtgccatagatgatagatgaacaaatggacctggctgtgttccagtaaaactttatttacagaaaagcaggtggagggtcacagtttgaccacaactgctctagattctagacattaataattaagtgcacatatacagatatatctgcctgcaaatatccatggtcaaattttattctaataaaaaggcttttgtgttctttttatttatttatttatttatttatttatttatttatttaacgaagcatagtctgtgttggcttttgataaaatcaatagtgtgaaaagaagatcttttccctggcaaccctttaaggttaaaattccaatgggggcattcttcagttgattttgcttaactataatgtgaattctttattctttattttatttttatttatttatttattttttgagatggagcctcactctgttgcccaggctggagtgcagtggtgccatctctgctcactgcaacctctgcctccccggttcaagcgattctcctgcctcagctccccaagtagctgggattacaggcatgtgccaccacacccggctaattgtttgtatttttagtagagagggggtttcgccatgttgaccaggttgatctcgaactcctgacctcaggtgatctgtctgtttcagcctcccaaaatgctgggattacaggcgtgagccactgcacccagtctcttcattctttattttaaacacatacattttattatgacactagtatgtaataataatggatattactatgtctactttacaaattgaaaagctaaggctcagaggaaataagtgattaacttaaagacctattgttattaagggagagaattgaaagttagactcagatccatggaccaaatgtttccacatctactataaaaatactattaagggttgggcacagtggctcttgcctgtaataccagcagtttgggaggcagaagtggcaaaatcagttgagcccagtaatttgagaccagcctgggcaacatagcgagaccttgtctctacaaaaaataaaaaattagctgtatacggtggtatgtacctgcagtcccagctacttgagaggctgaggcaggaggatcacttgaccccaggaaattgaggctgtagtgaggtatgatcatgccactgcactccagcttgggcaacagggcaggcccctgtctaaaaaaaaaaagaaagaaagaaaaataaaaatactaataaggctacatctgtttgtgaagcatattatgcatttgatgcatttggtaagaaaagcaatttatttatttacttatcattattattattattattattgttattattattattttgagacactgtctcactctattgcccaggttggagtgcagtggcaccacctcggctcactgcaaactctgcctcccatgttcaagtgatcctcccacctcagcctcccaagtagctgggactacaggcatgcatcaccatacccggctaatttttgtatttttagtagagactgggtttcaccatgttggccaggctggtctcgaactcctgacctcaagtaatctgtgtgcctcagcttcccaaagtgctgggattacagatgtgagccactgcacctggctaagaaaagcaatgtaagatcccctaacttaatttaaaagaataatgaaagagtatagggaagcagatgtcatcctgtttacaagggtgatatctaataagactctttcctttccatttgtcccttctcctcagtcaggttgcctatggtagaagccatctttaacataaacagcagggccccaaatgccgggaaggatacctaggaaagtgatcattcgtgcagtttccactttgggaaaaatttagtagacacttgaactctggcagcgccgctttgataccccatcggcaccaactcaattacctgccatttctgcagaaggattatttgttcacgaacgccggcggagtgggctgtgcttccagatccaatactcaattcattgagctgaaattaactgcctctctccagctggaggaaaaacaagcctccccggccatttccacaatggtaaagtgaattaatttattcgcacacactcaggagaacctgacagtttctctaccagcccaggaattccttggcacaaaaatgagattccttcccgtcccttgactggtttttacttaaaagaaaaatgtagcctaagggcaaatggtgggtgggtacggggtttatctagggaagagactgaaacaggaatcatctcaagcattgtaagagtcactgagtaactggaggtctggttatggaagaagagagatgatatatttttggcttgaaatgatttaagacttcttttaaaggaagttgtcaaaagacattgtaaatgccctaatctgttcttccataagaacctgagtctcgcaattgataaaggagatggcagattgacattttattttgtgcaatttgaaaattgatgaggcgtaatttactgggttgatgtttaatcaattcttaaaatcaacggatgcaatgacgtgtaattactgagctccttctagctacatagcattgtacaaaacacaaaggtgggtgcaatttatacccttaaggaggtggaacaagaacaatgttttgtacacaatagcttccttacaaatattatttgacttatatctgtaacaatcttacgtggttggtagagtaacccactttttaacttttgtgtgaaagcattccctattaatgccatgggaataacaaaaacgatattgtaaagtctaaatcttagaatccacaaatgaaaactttttctttcagatagtggagtagactatttgatgaaaaaggcttagcaagacacatatggagcttgaaatttcaagaaaatcagtatgaatctattgaaacacttccaaagtgtaaactaactaattttggatttaaaaggcttacagaaagaaaaagaatttacttttttaagagcaaaacatgggctttttccttaggacacgattctctctcggaatgataactccatcctccatcagcaccctgttatagttaatataacatgaagacttgcagcttagagatcaaacattaattctgatcttgcgactttaaaaaaaaatcgtgttcttcatgaaaagataaaggtacttaaaactgctttggctattcaattcttaaacgaaggtgacctccaacaaggaatgaaaaataccagtaccacagttacactggaaaatcaataacatagaaaagtgaattgaagacatgatagcctgaagaataggtaagattgaataaggatggttgagcctgtggtggtcaacatttctacattttgactgggaggaaatcataaaggaaaaaacagacggaaagcatgacattctgcaggctgtggcactagaaaagagctttagaaataatgtattttcttttaaaataattcagccaatgctatcttcagtctagaggatattttaatgtgtgacttaaatgaatgcttagtgacctctctgagtcaagaattggtcatgaaaataaacacacaatgataagtatttagaaggaataaatcacatcacacacatttttataagtgtaaagttgcaggaattttggcatttttagtatgcatttaggggcatgttgtctaaacaacatgtaatgtgaaacacttctgtttttccctcaaaaatgggaacactgagctatagaaattatctttgtaattatttaaatttaacatagctgctttagtaataaagccgcaatatagattgttaacaaaaaagattttatttagctgctacatagttaggttttctgagggtgtctttctttactatttgaacattgtgaatgaaccacaggattttgcacgtccaatatttgagtttctgatgaatgtgtggacatgttatcaaatatattaatatatcattgttcacatgaggatagcaagatctgaatttttcatgtttgattggtgtaaaccaacttgtcccttttctttttttcccctgctctctttacaacataacatgcaactctccagtaatactatagattgtaaactgtcttaggatagatgctgaagaatttgaaaagggaggggcatatattgaacctatctttccagccatgtcctgggctagccattgtttatttgttatgaaatccttacagcaatcttccaaaaaaggtgcctggatttcaggttgatctaaaaggacagttcagttctgcttgtattttgagttttggaaacttcttagaggtgtgtgcaagtgacatttaggtcttaaaggaaatcataccaatttggtacagtaagagtcacctggagaccttgagatttctaatactgagctacaagttgagtgtatctttagatcaccacaactgtgtccatgctcttttctctctttgtacattttgactagaaaatattgaaacctgtttcagagtcagtcaatttttcaccaagactgggtcagtgtgttatttaataaaattattctggtatttcttttcttttttatgtatgacataaagatataaaaaagtaattgtatcagaatctaatttccccagcatctctttccaatgttagtctcataaatacacagttatgtatatacacatatacacacatgtaaacacacatatacacatgtgtatatgcaaatttgtatgcacacatgtataaacccaaatatatgtacacatgttacatatgtataaacacaaacatatgtacacacatgaatgaacacatatatgtagacatatgtatacacatatgcacatgtgtacacatatatacacatatatgtatacacacatatatacacatatatgtatacacacatatatacacatatatgtatacacacatatatacacatatatgtatacacacatatatacacatgtgaatacacgtatatattataatatatcttaaattaaagaatcctttagaacaaatgcagaaacgaacattatctgactccggatgtaatttgctctagatcacctaagtcatgttcttaccaaagagcttcacctgaatgtaatcatgaggaagcaataagacaaatactggattgaatacaaattcagtattttatgaaacaactagcatggactcttaaaaatgtcaattctatgaaacaatgaaccaaaaatgtggagaagcaattctagatttgcaaaagcctattgcaaataaatgcaaagcatgttcattaaaggatgcctgaatttagatatggagaaaagagatttttgtgacaaggggcactttttaatatgggatggtacaatagataatattattgtatgaatcttaaatgtcttcaatgtgataattatattatggttacacagaagtatgtctctgttcttaggtgatacacgctaaagtatcagtaaagtgtccttactttcaagtaattcagaaggttgtgactatatatatatgcattatatttatgcattctatattaatttatatatgtgtattatatatgtatttgtggatacatatataatatcgactagagagtgcataagcaaaaatagtagagagagaaagcaaatgtgagaaaatggtaaaataataattagtaaatcttaatgaagggtatagtggtatttattgtattactatttcaacttttctgcagatttgacatttttcaaaataaaaacatgggaaggggatcaaatgcaaatccagttctcacagagagttatggagtaatggaaagttatgaagtacttcctgtagcaccgcttccctgcccagctatacctaggatttggttgcaccatattgtctatatattataatacaattccaggtgtttgcagacatagaaactgattttttttttaaatcctcactaattatttttttctagtctccgacagtggctttcattctgggaaataaccaaatgcattcaaagccaacccctgtgaatatggtgagttatcaaaatggcagcatggcacagtagggagcgaatagaaagagagttggaaaatttgacaaaggctatgagctcagatatagctcaaagactcatgatcatgggacagggagcaagtaaccaaatctccctgcctcagttttcttatatgcctggtaatgagctaacacaacacatgtaaaggtgctgtgcattagtgaaggtcaacataaatgatgggacttataatgtgatacaggaaccagacataacaaataccagaaaacggggaagtactgtcattgttaaaattcagatattcttgaaacaagaagatggatggtttttggtatgtcgtatgttatcttgttttttttaatttgattttcctaattggcaaattcatggggtccacagtgatgtttccatacaaataatgtatagtgataagatcaaggtcattagcttcccaaacatacccagctccccaaacatttatcatttctttgtgttggaaatgttcaatattctcattccagctatttgaaatgatatcatatattatcgttaactacaggcatcctacaatgctatatagaacagtagaagttattcctcctaaagaacttcaaaaatagtagtaacatgacattcataaataacacttggatgtatagtttgggtccatttgtttaaaagtggtgcattaagtaatacatcatgcatctatgtagaattacatttttatgtacataagcacttatatatacagaaattaaagcatcaagtgatttcttagaagctgctaaaaagtgagaagttcatgaagtggaatgaaataagagcaaatactaattcattatatgtagaataaatgtacacttttcagtggataggtttggtcagatgatggtactttcaacagaaaacaaatacaaggaaaagatttggggaactggcaggctaaataactaagaactctgcagaaaaggtcatcctttaggaaaaatacaatttttgtattctttaatgagttgcttctccaaggattattttttcccagaatcatcattaacacctctagtattgagtcacaggaatctttttttttattttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtcgttgcgatagtttgctgagaatgatggtttccagcttcatccatgtccctacaaaggatacgaactcatcattttttatggctgcataggaatcttataaattaacttctattttttaaactaggaggagggaaaacttggccacaatttttctgacttctagttcattttcttcttgttaaaatcatcatcccacttttgcctgatgcccaccagtatctatgaaatagtagtagtatattttattacctttcctcttctgtaaaatttttctttcacccaaactctgactcctgtatgcaacattctccatattctgccctcggagtctgattctgttttaactgcccatatccaaagagttcagttgttcccatggctgtgatgttacctttgtttagtaagaacgcatgcaccagtatgaagagatgtccaatggaaatctgacttcacactctgtagcacgcaagcccttcatctctcacacccttctgagtttacttgggtattgcctgtgggaacgatggtagtaaaatcatgcatggctggttcacatcagaaggagaaatttgtcctgtataaaaatgacctgtgaaagctgcaaacagcccagatgtccattgactcataaacggatataaaaatgtgctatatacatacaatggtatagtatttggccataaaaaggagtgaaagaatgaatacaagctacaatatggacagaccctgatgacgatatgctaagggtaagtccatcataaaaaaggataaatattgtatgattccattcacgaaatgtctaacacagacaaatccatatagacatagaatgagattagtagttgcctaaggttgtgggggtggatggaggaacttaggaggggatgaccaagggacagggcacagtttcttttttagagtgataaaaatgttctaaagttgattgtagtgatggttacacaagcctgtgaatatcctcaaaaccatgcgattgtacatttcagggggtgaattgtgggatttatgaattttattttaataaagttattaccctaccacaaaaactgttgaaggcagcctttgagacaatgttctgccaggcaaacactggccatcggaatgggtgacattccttagtccctgatttctttttttagccaaagactttgcgtgctaacacctgcaagacatagacctgcaaggcttataaaagatgtttatggcttggcgtaaatgcccattgctctatggggacaaagggtaacacttgctctaactaacttcccaagcaaagctcaccattccgctttattgttttggataactatacgcaagaaccagaagcgttgctactcagggaaagatacataactccaagattgagtgtctctcttggttcttcaccggctgcaaaaatgaatccatttgcatatgatcaacatataaaatagtaaatacagtatttgatcaagacattgattttttagtttacatttatgactgtttcttaataaagccaatcagtaaaaaacaatacagtttctttaacaaatgtgtcatttagaagcaattttatggtgggttcattctttcttcaactttcgttttcacatatttgtatcaaatgctttcaggacacctgaaatacctcccttaaacaagagttctcaggaataagttggaacaacactgttctaattgactcattgaccctttaacttggagtaacttaatttcagtttccttgtctttaaaatgtgcctgcttctagggggctgacctagtttttcaaattcattcttcaatctgtatgcatgtgtgtatatatatgcacatatatacatacatatgttgtcctttcagtgttaagaagacaagaaatggatataagagctagaaataatgtatcttctattgtcaaaaccacctgctaaggatggagactgggaaagagaagaccttctggctggctccaaaccccaagtaaattttcaggtgcaaaattttggcagaagctgtggaaagttaaatatatgtataagaaaacaatatttttgagaacttgctgatcaatccttgtgttgagaaatgatggaaagagaagagaagagagaaataactgagaaacatgaagctaggaaatccttggggtttgggtaaactagggacttgtttttttcttaaatagtcacgagcaggttttctttccaacttttattttagattctgggggtacacatgcaggtttgttacttgggaatattgcatgatgtaaagcaggttttgaacttgttaattgccttctctgtgattgtccacctgtctaacctctccaagtcaaatcttagtagaaccacagattgcttgcaagagtggggtgtcatagccaactttggaagtgaccctcaatgatccccacctcctgatcttcacgccattgtgtattgactgtgggctagattggcttctactgaatagaagtgtgggataggacacttattctgaggttaaattataaaatagcaaatgccatgacttctatctcaccactgcatcctttcttgccctctcacttagtcattctggtgaagccagccgccatgtagcactacacaaactggcaaggaataaaggtgatctctagctaacaccagtgagcatttgaggcctgcagtcctccagcctgcaagaaaatgaatcctcccaaccaccccgtaagagagcctgaaagatttccagtggagatttgagataactatagagctggctgatacttctaagagattctgaaccagaagacccagctaagctgtgcctggactcctgaactacataaatagtgagataattaatgctgttgttttaagctgccgaatttggggataattaggttatgtagcaataggtggctgggtgcggtggctcacacttgtaatcccagcactttgggaggctgaggcaagaggattgttgaggagttcaagatcagtctaggcaacatagtgagactccatctctgaaaaataaaaaaaaaaaaaaagctaggcatggtggtacacacctctagtcctagctacttaggaggctgaggtgggaggattgcttcagctcaggagtttgagactgcagtgagctatgattgtgccaccacactccaccctgggtgatagagtaaaaccctggttcttaaaaaaaaaagcaataggttactagtacatggtgcttttgccaaaataaataaattagaggcagagatccaggaggctatgtgtcagatggcacacgttatctggaaaaaaaaatcgaattaactcatcagtctcaggtaaagttacttaaagtcaaattgaaatatgaaagcataagtatctttaaacaattaaaaaatgccataaacatttcgaatcccatttaatttgcaatggagaatctgaggctctcttacttagaccttaagcacagaaatataaacactggaaataatgaactaaaatttaagcaagccttgtttataaattttaaagcaattatggtatttggtaaatatgtcttaggaaggaaaaagtttgttgagaagtagcatcttgtattgaggaattctctttggagtgaggcgggtaaaggaggttaaagaatatagtatgtttctcttggccaagcacgatggctcacacctgtaatcccggcactttgggaggccaaggtgggtggatcacttgagcccaggagttggagaccagcctgagcaacatagaaacatcccatagctgtaaaaaaatacaaaaaatagtctggcatggtggcatgcagctgtagtcccagctgctcgggaggctgaggtgggaggattgattgagcccaggaggttgaggctgcagtgagccctgattgtgccagcctaggtgacagagtaagaccccatctcaaaaaaaaaaaaaaaaaaaaaaagaattctccagcaccacaagaacacgatgaacaaggaagatgtcctctagagaagccagtgaggtggggggctgagtttctttttaaagtttaaactgtacaagatatgcttattttttagtatccattttctttcttctatggaaagaagaaagaaagagagagagagagaaagaaaggaagggaggaagaaagaaagagaaagaaagaaagaaagaaaagaagggaggaagaaagaaagaaagaaaaggaaggaaggaaagaaagaaagagaaagaaaaaagaaagaaaagaagggaggaagaaagaaagaaagaaaaggaaggaaggaaagaaagaaagaaaaagaaagaaagaaaaagaaagaaagagaaagaaaagaaaaagggagagagaaagaaagaaagaactctccttgatctataactgttaactgcaattttaaaaatttaatctgtaaggaaggtagcctgtagccatgaagtatataataacagaaaatcttgtaaaacacacaatgttttgttttgtttcattttgttgctataggtaattggacttttcttcattttagctgcagaattttgctacaggaaattagatgttctcacttagaatggacccaccaatcacacttaatttcaccaccatggattacctaacccctaagtctctcttcacacacacagacacagacacacacaggcacacacacacacttacttatgtaccatactgaagcaggagattttccctgaccccttcacgggtgagaactggagtgtacgggtgccagcaggggcaaactccactcactagtacctgctgcgctcaacccctcaagggagggagcacacaggtgagtgggtacagaagctggggtgcttttgggcatgtttttgggtgccagtaggaacaaactccatgctggccctgcagcaccatctggggggctgcccatgacccctgaagccccagaaggaatgttacagtcagtgctgctttagttttgccatccatgggtggcttaagtgttcacagcacagtggagagtcagtatgacagccttttgcaaccacacttatggcacccgagttcttgtccggcatccagtaggaatgaggtcgcatgaacacgttggagatggtaagtgtggaggatgggagatgggagattttattgcccattgaggtgactctcagtgggagtgggagctgagaaaggagacagagcaggaaggtaatctttggaagctacaccatcaagccatccctctaaattcaagctattgctcttcaatgtccaacagtagcctctgatgtccagctgcttctcctcttcttctctctgttggtggagcctggggtttttatgggcacaggttgggggatgcggcaggctgtgggtggttttggaaaaggcaacattcaagcaggaaaacaggaatgtaagttctcactttgggcctcagttctaggcttgagggtggggccctcactggggacccgccctcttctgcccagaatttccctccctcctgtctctatcaataccatatctctcttgttggtcagcatgtttcaaaatctcagaactctgccttccccatgtggataacttgaaatacaacacaatacaaattctcattctttccttgattgtaaagaaggtcgtatatgggtaaccaaccctttctaatttttcttttttttctgcaccaagccttcccttttccaccaaattcagtcagtctttctcattgtagtggaaggagttgaggtcgggagggcccaggttctaattgtactctatcactaggaatggccaggtcacttccaatcctctttataagaatgatgagtgaatttaaatctctttcaatttatgttcctaactactatctattctttcaatgcaagttttctcacatatgagtttttttctcccttttaatcttatgtccattaatccagttgtcttcctttaatttaatttctaagtagcctcctcaatgatcttgctctcaatgatcttgctctttttctgccccatactgtacctcttacattttaggaccacaccaagtaattattttaaaccattggtttgactaatcacttgttagttgaaaggcattcctcaatttcctgtttttcatcctccacagacctttccaatcctgcttcaactatattttcagccctagcatccccactgtctggcttacaatatcttaaagtatctggagtttttcttcagtctcatgctgttttccctgtcagcaatattgtttccatttctgtttgggagtaaaaatcccacctgagcaaatgtttaacataaagtaatataacatatatttaacacagcataaaattttcacataacgtatactttaacctaatttttttttgagacagggtcttgcccaggctacagtgcagtggcacagtcatagttcactgcaggctttaccttcggagctctagcaaccctcccgtctcaacctcctgagtagctgggagtacaggcacctaccagaagcctggctagttttcatttttcaattttttgtaaagagaaagtctccctacgttgcccaggctactcttgaactcctaggtttaagtgatcgtcctgcctcggccttgcaaagtgctgagcttacgggcttgagtcacaatgcccgggtaacctaacattttttaacctgacaaagttaacctgacaaatttgtatgtgtgcaatacaatgttgttgactctgggtacaatgtggtatagcagatctctacaacttattcatattgcttaactaaagcttcatgcccattcattatttggttgtcttttaaattgaccttctgtaaaggtaaatttacatcccattgtatgggaaagccccatggtcatgaccttgatggtttacttatatgatttgcgtcctctttcttggtgcacaggggatacactccatccatacctgtcaatatgatactgctaaacatagaatgctgtttcagagctgagtaagtggtaaggctgacataattttggtggagttgcaatggaacagtgtaggcatatgtctagtagagtgttcagtgaggtttaattcttatgacattcctcatggtacaatatgaggtcagacatcaaaacgatggatttccatggtgttttcccccagtgttcagctactatttgaaaccacttttattttatgttgccagggatttctggaagatgggattttctttttctaggtcaatgtaacaaatcaatatgaatttagtgccataaaacaacatccatttatgagctcacaatttctgtggattggacctcctagcatagtatggctcagctggttctctcctttgagtcacaagaagaaaataaaattggaggcagggctgtcttcctctctgggagcttgagcagagaattgtttccaaaatcatcctggtggtttgggagaaggcagttgtagaatggagatctctgtttattgacaagctgttctcaacttccaggggtccttgctatttccttgtttatggctccctttgaagccagcaatgatgggtcaagtcctgttcatgctcggaatctctctgcctcattcttactctgcctccctcttccacacatctctctagggcctcatggacttttaagggctcatgtgatgacactggactacctgcatactccgggatattctagtttaaggtctgccaatgagtaaccttaactccatctgcaaggtcccttcacggcagattttggagtcgtgtttgagtgaataaccaggggaaagactcttgggaggacgtctttgaagtgtgccaccaagatggagagcagttagccccatgtccagggaaatctctaaagccaaaatcaaaccaacaatggaatgatagcagaagccagaggcaagatggggggaaatcaatgctaggtgttaaaccatgtgatccttagattcagattcttcttgtaattcagatacagattcagaagaagaaatgtagatccctctcctttgaggtagagagtaaatgcagcaaacggcttgagatagtagctgtacctactctgtgttctgttctactcttctttagcagtattgaaactcatgccatgctacgcatttacctctgtgaaagataatataatctcaagaccccaaactcagcataccaaagggaaaagtgaagcttggaagctgagtcatgcaaaaactgcctttcttttgttcccaaaactgcaatttcacagccctgtgtcattgcctcatccataagccaggttcctgcaactatagaaggccatgtatctccccagatggcctctctcacaaattgctcacaaggaaattccttgtgagcccctaaatctttcaggatacatatccccagtataaagtagcactaaagccaaactctgctgaatttcttcctaacaatgtaaattactggcttatcttcccaggtatgggacaaagacaagtctagaaatcattcctacactcatcccaagacaaatgtgggactgactttttcttctactccctctttccacatgtttatcctatattaaatgtagatttacagagtagggatgaatgcaggattgacttttcctctactcccttttccactgtaaaatgtagattcactgagcactaatcaaagcctcacaagaatgcaacccacttgcctcattgcttgtccatcttccttttttttttctttcccccttccccttctgtttgctctttcacctttaaatattgaatttctcaaaaccccctttggaataagcacaggtcgcagatgttcctgtgatatgttttttccagtgtgcctcctcaacctaggcaaaataaacctcttatcgactgagatctgccccagtccctttttggtctacacatcctagtattttctttcaatattctctccactggagaatattgctttttctcacggaatgtttttgaagatctccaactcattctccaagagaaggcatgagttcccttttccaggaaacctttactagtcctccctggccacatttgctgcatctgcttcagtgtttctctacagcgcctgcactcttctattccctggagcacacattgcactttttgccggcctatctttaactctagattgtagctccttcatctttatttctatgcagcctctcaacagttcctgagatatggtcagcactaaatcaatatttgcagaatgaagtgttattatgataaattaaatagcaggtcagtgataaatcgtgttgttgaacgttgctagtgaaaggcacacataattattatgctgcagctttagtggttacctagtgaactcaaaagtttagagcatttctttagggctaaatgatttttttgtgaataacaaaagcacaaaagtacaattaaatttaaatatttatggtatgttaacttgctaagccaaggcagccagaagaagaatgcctgagaaagccgcaagtcaaccccagggggaaataaaaatcaacacttcatctgcagagttgcagctaatttgctgtaactaatactatgacttccatggacaatgtcaagaacaaaagattgccactggagccttggtcctttgagaactgagatttatcacacactctaccattaaggttgtgtgggtaaatgaggttttgaaaactctctgtagccatccttggttgctttgagttgagtccttgtcaaaagtagtattttacccagaggagcaattggcaatttgcacaaaaccctttaaaatacctttgcctatgctttgcatgttggcatttggtcaccttcctatgtgcctaaagtatgaaaaggaagcatcagtgattttaccagtaaaggaagacaatctcagtgctctcagtagtttgcctactaattagttagtttaagtgctctgtaaattaactggcatggatggtgccaggaattattattattgaataacaataatctagatgtgtgtttattttctattgcagttgtaaccagtgaccacacacttagcagcttaaagcaaatctcaagtattgtccgtcagttttatagataagaagtcagcctgggtagcatagtgagaacttgcctctaccgaaaaaaaaaaaaaaaaaaaaaaaaaaaaaaaaaaaaaaggccaggcatggtggtataagcctgtggtcctagctacttgggaggctgaggtggggggattgcttgagcccaggagatctaggctgcagtgagccataatcacaatattgcactccagcctgggaatgtctcactgtctcttagaaagaagaaggaaaaggaggagtcatctaggtggcaggtggctcaacaggttctctgaactaggtctcaccaaggccaaactcgaggtgatccctagattggagtcttatctggaggttctggggaaaatctgtttccaagctcagtgagatttttggcaaaatgcaggtctttgtgatgtagaatggaggtccccctttgctagctggctgacagctgagggttattctcagattctagaggctacccacattccttggctcacagccaccttcctccttcttcaaagccagccacagctgacctactttttctcatgcttcaaattgttcctgcctcctctctgctgcatttctctgaacacagccaggaatggttctcttcctttaaaggctcatgtgattagattgagctcacccagataattcaggatataatctttccattttaaaggccatggtataggtgtgtacaaagagcctttggccattgtatgaatttgcgtgggctaccataacaaagtacgacagactgggtgacctaaacaacagatatttattctcccacagtcctggaggctggaagtccaagatcaagctgtggccagggctgcttcctctggaggtctctctccttggcttgtagacaccatcttctccctgtgtcttcatataatctttcctctgtgtgtgtctgtgtcctaatctcctctccttaatcctattggattaaggcccactctagtaacctcatttaaaattttaaattctgattttgaacctcattttaaattcctctttcaaggacctatccaaatacagccatattctgaggtcctaggggttaggatctctgcaagtgaatttggggagcacatgatttagcttataaaagccatgtaacatagcataatcaaaggtttgggagattaaaacatggatgctggtaggaggggatgttatttagcctaccacaaagttgaacttttgaaaaacagcaagtatttgggtatatcatgagaactaataccccaaaattcctgacatttttctgtatcaatgataaaagtttttcataaacagctctccattatacttgaaacaatctgccttcctgaacccccagtagaagggctccctcatacttatatgggataatatgcaaactaagctatgattcataatctttttctctttttttttttttgagatggagtctcgctctgttgcccaggctagagtgcagtggcatcatctcagctcactgcaacctccgcctcccaggttcaatcgattctcctgtttcagcctcccttgggactacaggcgtgcgttgccatacccagctaatttttgtatttttagtagagacgggatttcaccatgttggccaggctggtcttgaactcctgacctcagatgagtcacccacctcagactcccaaagtactgggattacaggtgtgagccactgcgcctggacctatgattcataatctaaccatcactgaccttggatatcttgaaatacaaaaaaaaaaaaaaaaaaaaaaaaaaaaaaaaaaaaagtcgccaaagccacccaaatgtaattatttttagtgttaaataatctaaattttatcttattattaaggttaatgtcacctggtgaagaacttctgttctgtccaattgagtagccatcagccaatacggctatttaagctaaaattaggacttaaaaagagacaaaatttaaaattcatttcccagatgtatcagccaccttatatcaatatccatgtgtgactgatggccttgatccttcacctcataaatatggaacatttccatcatcacagggagctctattggagaacaccagtctagacagtaatattctgatcttttaatgatgtgattccctcaagctcatgtatcctgataaaggacattacagtctggataaagatttcttattacagcaatatttatgttgattaatttatataaaggataattatctattaaatacagagctaaagaaattaagaccaccatttatattgaggatgtcaatcaatgaggaaacataatttacagaagagaaatctgtctgcttcgtgtgcttggttcaatgttctgacaggtttccaggcaagtaatgctggttttcatccaataatgatggattacacccagtagactcccaaacgcttggctttcagttgatcattcttagacttggtatttctctaaagaagttcaagtaaaaattgctgaactgtgaaaattacctcctgatgcagacacagtcattgttttatataaagagaaaaaaccttgtaattcagagtgtattaatgcaagcttgagcttttgtgtatttgctaggtgtcaaagaagtgcaaaacctcataaaagtcctttacatttgtttatttatggataccaccaaatgcttaaataagttttatttgaattcacataacccattgatgttttaggacaaattttaaagctggacagatctttaaaaacaagtgatgactttgtatacctcctggtgctaattgacagtgctaatgtgtggattcaccatggaaatctagaaatgagagctatatgaatagaaacagaggagtggaactgtgaaggacagcctgtttttggcttctctatcagaaagaacaaaatctctttaccagttgacattaacctgaatagtaaggtgaaatttagattatttaacactaaaaataataagatttggttgacttttttgtattccaaggtattcaagattagtgatggttagatgaaaaaccatagcgaagtttgcacattatcccacaaaaatatgagggagcccttcttttgaggtttcaggatgcaagactgtctcaagtatgatgtagcagctgtctagataatgttggcagctcatggcctgatcaatatctgtgtacctggattttggtgaatatactgttggtatttataagaccagtactctccaaatgtaaaggtatgtttcaagtgagcaatggctaagcctgtacctatctccctggttgtgtgactccatgtgtacaaaactggtatgtaaagattttctctgcatgtgaatgagaactcccacatcattggtatcctgtcaagtctccatctattagacatcaataacatggaagcattttaccacctacaatttttctctagcccaaaatatatccaacactggaagatccctgcctctacatggtgaagccttctaatcttttgttctcagaggtgtagaagaaagctctagaattaaaatgttaggacctcaaatcatgacacaaccaccccccttatgtttggtgttgggtgggtcattaaactattctgagcatctgattaaaactacagacacaaacaactattaatccaggttgttggaaatactaaatctgatgcatataaagcaccaaggctctgtgcacttttcctgtaaaacaccaaattgtaaatatgttaggctttgcaggccatccgactttgttgtagctatgtaactctgctattgtgacttgaaagcagccatagacattatctaaacaaatgggcacatctgtgttccaataaaactttatttacacaaagcaattgtgggccggtatgtaggtaaaaattctgtcaccatgtttttcctctgctctcaccaccacaacaatcatcaacacagaagaataagacaaatgtgtagggtttttactcacacaaaaaacagtggacaccatctggttgtcctccaattcagttctgacactctctacccagagatagcatcagatcccacaggttaagggctcagtcccatagaccaccctcttctttcccccagtcacaagttcaggcctccggtacttctgaccaagtgacttcaagttgtggttcccacaatctcctctttgggtttgattaatttgtcagagtggctcgcagaactcagaaaaacacgtatagtggttgttaagaaggatattttaaagaatacagataaacagccagatgaagacacatagggtgaagtctggaactgtctggagtgaggagttctttccctgtggaattggggtgtgacactgtgccaatacatggatgagctcttcatcccccttctgttgacctccacgtgttcagctctccagaagccctccacaccctgtccttgggatttttctggatgcttcaggatgtaggcatgattgattaaaacattggccattggtgatcaacttgatcttcagcccatcttccctctctggaggtaggggatgcagctaaaagtccctaccctctaatccggccttggtctttttggtgaccagtgctaccctgaacctatcagacaaaagacacataaaagacagcacttaggagatcccaaggattttaggagttataagccagaaactgtgcatgaaaaccaatatatataaatgtcataacactacagccagatttgccctgggatatagattgtagactcttggtgtatagcatctaataatgtttggccaaaaatataatagttggccaggggacattaccatctaacactttatgtccttctctccccttaagtctccttaattttaacacttgatgtttataaagtaacattttcctactttaccaatcatataatttctctttttagcttatattgtttgtttggaatgaaggaaaaccctacatttcttatttatacagtttctaaagtctcatggaagattaacaatagttgtccacaactttaagaattggaaatagtctagaaataattatcagattcattctaccttccaggtgtttattacctatccacttttgatttggaaactttaaagtatttaggagagcattgtcattaaaagatgaagttattatcagaagcctgttgcagaaaacttttcaaaaattgaataagaaagactatataatctctgagagccaacaccataaacatactttgcttagacttcatcctttttaagtgtggaggcttatttcctaaatcatgcttgtgatgttatgatctagtgtaaataaaagcgagatatctagatcccaaattgtacctgctataaaatttacagtattaagtttttgtgctgtgttttctgacaagatctagggatgtatccatctgcagaactttaaacattagctgcttctgtgtggtgaggcaaaacaccagcacacagctaccaacttccagctcgatattattactaatgaaatgctgctaatagttataaaatgcacacagagatgattatagggccctccctacaagacaagaacatgctattgtgaatagtgctgcataatgaacacattgtgaataacgcacatatggtgtttctgtcccattgctgcaggagttcctgaaatcagtcttctctgatcctagacattgaaactccctgtactcactgtgaccaaccccacactctgtgctggttttgtgcctcaccatgtagatgcagctgatgtttaaagttatacagatgcacatatccctagatcttgttggaaaattcagcacaaaaaccttatactgtaacttttatagcacctaccagttgggttctagactttccagggaccttacctgtttagtcttaatttacagaggcaggtccttctcaccatggttctcttggtgtgttctttcctttccttcttttttatttttagagacagtgtctcactccgagttcagtggtacaatagtagttcaatgcaaccttgaactcctgggctcaagtgatccttccacctcagcctcccgagtagctgggactaatggtgcctaccaccttgtagatagagcatctcactatgttgtccaggatgtcctcgaactcttggactcaagtgatcctcccacctcagcctgaatagctggaactaaaggtgcatgctaccttgtagaaatggggtctttctatgtcacccaggcttgtctcaaactcctgggctcaagcgatcctctcacctcagcctcctgagtagctggaactaaaggtgccttccccttgtagagatggggtcttgctatgttacccaggctagccttgaaatcctggacccaagtgattctccatttcagcctcccaaagcacagggattataggggtgagccaccatgcctggccatgttctttctttaatatctactttaagtctatctattcaggaaccttctgggctctcttctaagattggccctcagtaccatttctgtgtggttctcaggtccccttctctctgcagacccctcccctttgactctttctcttccatgataaaccccctgcttcaacaaagggaagaggttggaaatcagtttgtcttgttgtccacaataaagttctgtgattattattatgagtcaagactacaccctggaatgctctttgtcctctgcagataatgagcattccctgtacacatcatactaaaaaaaaaatccataataagtataattattgtgatttttattaacgtcctccaaatgataataatagcagtcatgataacacttattatgctgttgatgcatgccagatatttaatctttgaggcaacattatgaagtgggtgtaatgagcatcaccacttcatataaatggagaattggcatctctctaccaagtatggaaagctgaccaatagaaatgttaagttgtcagccgggtgcagtggtggctgacgcctataatctcagagttttgggaggatgaagcatgagaaaaatttgaggacaggagtgggagaccaacctgggcaacatagcaagactccatttctacaaaaataaagaaaataattagccacgcatggtggtgcacacctccagtcctagctactcaaaaggctgaggcagcttgagcccaggaggtggaagctacagtgagctgtgattgtaccactgcattcaagcctggataacagagtgagaccctcgtctctaaaaaaatttctttaaaaaaaaagaaaagttgagctattgagtcaagactccaagggctgagtcataatgcaactatgctgcttagttaatattaattaaattaaataaattaatattaaaccacgcttgtctggtgcaggtacagggagtgtgactgatatccatcttacatcaatttacttcctgatacttcatttactgtggtatgaactcggacaagaacgtaaccattctgtgcctctgtttctttatctggaaagtgggaaggaagtaacaatgtgtacctctaaggactggcatgagttaatttataaaatgcttgtaagaatcatgacctacattcattgctcataaacaacagctactggaaggcagttgagtacatgtttctgcagcttggtgaggggaacagaccggagatataaatttggaggtcagcacataaaggtgctcctggaagccattaggctggatgataactcaaggcaaaagcataaatagtttcttcattttctttaaattaggaagactaaactgtattagtcagggttcgctagagggacagaacaaataggatagatgtatatataaaggggagtttactaagaagtattgactcacacaatcacaaggtgaggtcctacaacaggccatctgcaagccaaggagaaaggaagccagtccgagtcccaaaacctcaaaagtagggaggctgacagtgcagccttcagtctgtggccaaaggcccgagagcccctggcaaaccactggtgtaagtccaagagtccaaaagctgaagaacttggagcctgatgttcgagggcaggaagcatacagcacaggaggaagatggaggttggaagactcagacattctagtccttccatgttcctttacctgctgtattctaaacaggctggtagctgattggatggtgcccacccagattgaggttgagtctccctctcccagtccactgactcaaatgtcagtctcctttggcaacaccctcacagacacatccaggaacaatactttgcatccttcaatccaagcaaattgacactcaatactaaccatcacaaaaacccacaattaagagaaaggagaaacctgaagtttaaaccatattgcccagcattgcagaatcaagcctttctaactgaatgtattgggaataaaatgattattctttctccagagctgcctcatttaatcatcctttactctaatatattagtttcttctggctactgtaaaaaaaaaaatcaacacaaagaccatttgcttaaaacaatggatatttatactttcccagccctaaagctcagaagttggaaatgaagatgtttccacagttggttccctctggaggctctgaggaagaatccgttccttccccctttcctagcttctggaggtggctggaaattcttggcattctttgtcttgtagatgcatcactgcactctttaactcatcatcccttggggctcttttggtgtgtttctatattcaaaccttcctctaaggccgggcgtggtggctcacgcctgtagtcccagcactttgggaggccaaggcaggtggatcacctgaggtcaggagttcgaggacagcctggccaacatggcaaaacctcgtctgtactaaaatgtacaaatatatatatatatacacacacatatatatatatacatatatatatatatgtatatatatatatgggggtgggggcgccgtggctcatgcctgtaatcccagcactttgggaggctgaggagggcagatcatctgaggtcaggaattcgagaccaacatggccaacatggtgaaacctcgtctctactaaaaatacaaaagttagctaggcctggtggtgtgtgcctgtaatcccagctatttgggaggctgaggcagggcgaattgcttgaacccgggaggcagaggttgcagtgagccgagatcgtgccattgcactccagcctgggtgacacagcgagactccgtctcaaaaaaaaaaaaaaaaaaatagctgggcatggtggctcacgcctgtagtaccagctacttgggaggccgagacaggataatcacttgaacctgggaggcagaggttgcagtgaaccgagatcatgccactgtactccagcctaggcaccagagtgagactcagtcacaaacaaaacaaaacaaaaccttcttctaatttatcataaaaagattccagttgttgtgttggggtcaaccctaatccaatatgacctcctgttgacatgcttatacctgcaaagtccctacttccaaaaagaggcataatatttacaggtgccgaaggttaggatttgaatatgtaggtgacacaattcaattcattacacctagtaatcgccaactgagataatgttttggaaatttatgtagcaatgttataaacatgcaccctaaatctaaaacctccaggcacactttatcaccaggtaagcattgtcatttattgaacctggatggtctagcttctggaagttgaccaatcagaggcagcaagaactaaggcatggagctagaccctccccaccttggaagaccaggaaggtgcaacccagctgcctggctgggaggagatgggaagtctgaagcagtacatcagtataaagaaaattccaagagcctttctcttggaagacaataggagagtctgcaaaggccacgcttcacacactcgagaggagaccttgttgctgcaatgtgtgttgagagttaacggagccatgtgtaatgggtcatgtccaagaaccgggttcccttctgaggagggatctggtgagaccaaagcagaacccctaccctgataagattagggtgctaggatcagacaaggcttgagcaaaacactaagtcttcagatatagagcaaagagagcagtcttcaggtttggatgttggtcccaaggccgaaagtcatcagaacaggagccaaggaaccaacaataagaagattgagtctcagagtgttgacaagtctcttaaatccttctgcctaaaatggaaacttaggagtgagtccatggggaaaagaagtaagctaaggtttgcaggtgcaaggtcatggtcagactgtagcagagattgggaaccaacatggttggcgagacctatttgattatcaaagtctttggaaaatattttgggggcttttccgacaatctagggaagaggcagactcacatgaaccctcccttagcttgggcccaaaaataccaagatcctgatatcaacctgaaaattagcatagattattagggcattgaataaattcttgaaagcgatgctctaaaaataaaatgaaatggaaactcgtgttttaaatattgatgattctggcaccactgcagtcctttgatatagatgttgttgctgtaggctgaattaattaattaatttgcatcaggcctccaaaactcaatgtgcttctttctaaactaatgtgcatgttcacaaacaagtctgtaagacagttgtcaaagtaggacatcaaaccccaccttggtttccatccgttcagtggcttcagtttgacaattgttatggaatcttctggggctctggcattttcaatgcataatggagacacaattgaggaaatttatttattattgggagactactaaaattcaataccgaatatccctttaagctattggcattacagtatagatgtatttggttcacggtggtgcagaaatctctttccaacattgttgtagaaaaaatttgtggattgtttctttgagtcagggtctttttttttcagtggttatcactgatgaaagtgcagaattttcattttatattttagtctttctattggtaattatgtctgtcactatgctaactgttcatggtgtaaagatgaatatgggctgttctgcctatggggtaccccggctgtctatgaaacagccattttcctgtactctgtagctctaaacttcctttgcttttacttaaaaaaagatgaataagacccaatccttaccctcaacaggattaaagtcattagggaaatacacactttaaaaagtattaccagggccgggcgcggtggctcacgcctgtaatcccagcactttgggaggccgaggcaggtggatcatgaggtcaggagatcaaaaccatcctggctaacatggtgaagctccgtctctactaaaaatacaaaaaattagccgggcttggtggtgggcacctgtagtcccagctactcgggaggccgaggcaggagaatggggtgaacctgggaggcagagcttgcagtgagccgaaatcgcgccactgcactccagcctgggtgacagagcgagactctgtctcaaaaaaaaaaagtattaacattacatcatagtgttgaccagatgtccacacactctaactgtaggccataattcatcttatgcttattttgtatgatgggtaaaataattttttacatgtttaaataattgggaaaaaaatcgaacactattttgtgacatgcacattatatcagactactgttaccacatgatccagcaattgcactctttggtatttctgcaaaggagttgaaaacttatgtatgtccacacaaaaacctgcacatggatgtttgcagcaaccgtattcatcattgccaaagcttggaagcaaccaagacgtcaccctttagtagccgaatggataaacaaaccgtggtacatccagagaatggaatattactcagcactgaaaagaaataaattatcaagccatgaaaagacatggagaaaattgaaatgcatagcactgagtgaaaaacaccaatctgaaaaggttacatactatgtagttatacccataggatattctggaaaagccaagagcttggagacaaagatcagtggtcgttgttgccaggtattcggaggagggagaaatagggtggagctcagaggacttttagggtagtgtagccattttgtatgatactatagtagtcattatatatttgcccaaacccacagaatgtaaagacagagtgaaccttaatgtgaactatggactttaggggattataatatgtctacgtaggttcattgattgtaacaaatgcaccactctggtggaagatgttggtagttggggagactgtttgtgggggggtagagggtagatgggaactctctgtatcttcctctcaattctgctatgaacctcaaactgatattaagaaaataaagtctattaaaattatgtgaaactcaaacatcagcatctacaagtaaagttttattgcaacacagccactcccatttttttgcatatggtccgtggctactttcacgttagtgaaaagttgagcagttgagtcagagaccacgtggccggcaaagacggaagtttgtagtatttggttcttcatagagaaagtttggtgatctctttcggtgatccctggactatcctgaaattctgagcaagacatcatcatgatcaaagcaggagtagtcagcttagcttttctgcgttattcagagagctttttgagctgtatcttgaagaatgaggtggggttgaggtttccaggatctttctgtcatcttcccacattggtattgtattctgtagcatttattgtgaccaacacacatccctgaaaccaccaggggctgttatttcagaaaagtagatgtaggacactaatttctcatgctgccattgaaaagagagcctcacctgcataactgagtttttgacattttaaatttttttgttttaattaacatccatcttagaattttcactattgttctccataatgggataaatatataaagtaaatctctcaaaaagacaggttttaaaacacattgcctaatgtcaaattactcatataaggataagatttcagccttgtgattttgtaatgtgtcaacctgcctagactaaattacttttcctagaatcctcccacctgtgtgtttctatcttttgtgccccacaaaagccatttttatcctggtttggtgatgaagccgggaccccccttaagggccttatgaaagtgaagaaaaatctcgagttccttcaggggaaattccaggcatttggctagccttgaaaagtaaatgagtaacttgatatccaagaaggtaatggtactttaaaacaacaaccaaggaagctagagccaggagatactagttttagttcctataggaactaaagataacatcttgacataagtccctgagttgttgttcagaaacccagacccccacaaaatgcatccactggaatgtagacctcagttacggggcaacggggcaaccgaggactgaactctaaccaccattctttattttaaatgtcttcctgagggggttggaggaagtcatgtccatgagtcagagctaacattcttttctgctgaccccaatttttaaaaaaacttctttcccttagctaatggcaaatcagagaatccttgaatctacctatgacctgtgagtcctctgcgtcaagatatcctgccttttaggtcaaaagcaatgtataacctccttgtattgacttaagattttgcctgtagcttctactttcctgacatttacccctgtgtttacaaacccttacctgcaagccaccgggcaggtgggatcttaggcatcaactgtccaactctctttgcttggtgcttgcaaataaatgcttcacttcctctcgctgccatcctaatgttagtgtttgactttgctgtgccaggcgaacagaccccagttcggttctgtaacaacatcagggcaaaagtgaagctgcagccatattgcttttttgcagtcaaaattagggaaacaaatgagagctgtggttagctcttacctgtggcctcacctcctttgcatgggggtagccatgggacctgaagctgctctaccttttactggactccttttccggtgtgcattcagctctgtgaataaggggccaagcttttgctgcaggatgtctaggcatcagagggcagagagaaaaagacatggatcacagatcatcctcctctttctagatcatgcctgtggctcccagctcgttctcacgctccaattttataggcagcttccactccaggaaccaagaatttcccttgtgaaaggaaaataaaaactcaggaccccagtttgctatgcaaaagaaaaacaaaacaaaaatttaagctaaaagctgagtcatgcaagaagtggccttttccttttgttcctaagcagatagctacagataaaaggttaaacatcgccacaggtggctgctctatgttcaccgtatcttatgtaaagtgcccatttactgagtgcaagaggaatgtacagttgactattcctctacctgctccttttctcttgcaacctgtagattgagtaatgtgaccatatcctccctctttcccctctagcccacatttcccctttaaatattgaagccctcaaaatcatctttggagaaaggcacagaccacacagcatttctgtgattcatgttgatctcttctggacatgtccttcttcttggcaaaataaacttctaagttgattgagacctgtgtcagatactttttggtttacaccctcaaggagaatcccgccttcctcactgcccaactgcaccaggagttgtttgcggtcttttgtgtgctgattggtcatgttaatcactttcttcttagttggaagatagagttgagagctcagtgatgtggtttttatattgtttcctgtccttccatgcatgtgggtcaccaccaccaccctatctagacagtaacctcctcaaaaacagggacgtcacgttctactcctatgtccttattcctttgctgatgccctgaaagatataaatgcagggtagcatggttatgcaaggtgcaaacacatgcttccttttgagtcaggtgaactaacacttgaacaattaaaagcaaagggcaccgtgatatacagagtagtgcaaacagactcactcaaaatgcagtatgtgcgcagcaggcaggggtttaaattgcgtatctcatgtgtttgattgcaaatgaggaaaactgtaatagtcaaagctatctaacatgtaggttgtggtactagacacacaagcactcattgtggtatgtcaggtaaaaacacatctagatgtaggaaaggaaaactttattcaaaaagattattgcaataaggaggggtactgttctaataatgggaaggggagtattggcatgtggagctgcacagagggtaagatcttcaagcatgtcaaaggtcaggcagaaaggaatttagagacaatccactggaaaggaccagacgtgggcgagtgggtgacatacttggaccagacaatgtcttccttgtggtaaggtcagttaattctcaggagagacccttaagagggtctgtgtcctggctcaaactgagattgggtcaaagttcagaatcctctgggcaaagcagagatgtaaatgaactgggtccaatcctgtgaatgagcattgcattccgatgcatctgtggggagcaatagtttagctaaccttttatgaggcaaaaaataggaatttgaagggtttgtgtatgtctttgtcgtaagtgaaaatgacagtgggagggcatccatgaatcttttcgaaggcatgggggaagggtggtttatggagtaaccggtttctcagaacacaccaaaaagtacagggggtatttcttcattgttactgttttcctggagcacaggtatagtttaacattgtcaattgcatttatgacttctggttccttcagtagccttcaaagtcaaggctacccatccttaacatgtaatgttgcatgtacacacacacacacacacacacacacacaacttatatttgccttgtgcactgggataaatgggtgagtttattgagcccagtctctctaccctggtataccattaggaagatctgctataaaataggtactattatccccatttttcagatgttcagaatgaatctcaaagcggtcatatgatcttctctaaggtaagatctacatttctaacttctctaactttcctacttaatagtaggacaagggtcaaattccactggcactggattccagtcttcctgtcctctacatttttaccccaaaataaccacaataaaaagattgtttcttagtttttgaggcagtgtgcttcacggatgtcaaagcaataaaacttgaggacaaaaagacagacatctagaaaagtaagatgagcgttcactcctgtcacctcagtgaaaaactgcaacctgtcatgatgttttcttaccagaaggtagagattcagttgctgggtgtgggttggagtaaaacatagaaaacttgagacacaaagggagctctatgtttgaggcaagatggcaaaatggcaagtaaaagtcaaaatgacgtccttccattttctctgtggttgctgtctttggcggttttttttgcaatcacagtatgatgagaaggaaggtacatctgtatcaaaccccatgcataagtacaagcaattgctcctatgatagagtagcctgttagggaagatttatttgataatcaaacaaaaacccgagcaagttctgcatgcccactggcaagaaaaacatttaaagagggctaaccagcacggtttccctttccctcccctttctgtcttacctgtccttaaaatgcatccaactgagatgtcaaatactttgcagaagctccttatccacaaagcaagaccaacacttacaaccaaattgcaaagaaacatattaggtttctagatggtctgatttagaaagcatatattgaaccacaaataatggattaatggattctccgcagtactcagccagatgaataatgatggcttgattcagcagtgggagttacttatgggtgccggctaatcagggccagaggagcaggtcctggctgccttttccttgtgcatgctcggaggtggccaagtatctttctagatgacaaatgggccgtgccagggagtgtaaaatgtacaggtttgcaatgttccgtgctatgttggctcttgttgaaaaaagctgcagaaggggcaggctgaacttatcctgcatcctcgtccttggaagctaaagctcagatcactctgtggtcataggctggcaggtgcaatgaagggtgaggagtttgtttctgggacgttgactgaaaaaatgactttaatctgatattcataaaccatagcaactggcggttgaaaaaaaaatgatttagtaacagaggccagcgtggtagaggtgaacaaaaaggaacgcaccaagatggacgtgttacaaaagcaagggcaaaactggttcacccaaaatatttgtatccttacttctacgatggaatggcgtcttttccaaagcagtgggatcttttggaacaaaacatggggaggtagttactgtggttggttgggagggaaatgaacatctctgaagcaaacgttttctattttaaacaaaacaaaacaatacaatacattctagcccctccaaaacccccctttccctttctaaagactaggtgaaattcatattttaattatgtgattcctctcccaaatgggatgacgttgtcagctatgaattaccaaagctgcctcttttatctccttcccagaatacacaaagcaaaggtctaaatgtgattttggtgaatatgtacttttttttttttttcaaatgacagaggcaaagaggggaaaatgaatgtcttaatcctacagccccctcctggggaatctgtgccacagggaaatggaaatgacagtggggctgagtgatcatgtggttcaactctctgcctcttcctctaccaaccacctcctcctgctcttccatcaatctccacttttctacttttgtgcttttgttcctctccctccaggttctcccaggggtgcacacactcatttatttattcagcaggcacacaaatgatttaccctgagttcgcgggcaaagcaattatattcttaatcaaatcaagatgaactcaggaaatagactacataatttcttgttaagagtgagcatctctttgaaaaagaccataacatgtattcagtggtgtatgaccagtcggtcttgagatgactcaaacccgtttagctgttttctaaaagtcacagacagtgcttttccaaatgattcaaattatcggggaaaaaatcttaaatcatctgaacatggaaatcaagtatactccaggatatcaagtatattccttaagatcggttggaatgttaaattccaacatttatatatatatataaaatatagcgtgtacatatataatatagtgtatatatagaatataaatatatatgtgtatatatatacacatatatatatttatattttggaaagagacttggagatttaagtgattcatcctgtcccttttagcattgttcacttccaatattgaaatcaatttttcatcctttgaataacttggaagtttcccctccacatatgtttttcaatgagccttttacagtgaaataatgatgcacataaatcctctcttctaaaaggaaggattgggattttacctcctcttcaattgaagatctgtagactatttccattaaagatgagttattccaaatcagatccaggtagttaatcagttgctattaaaccagagtaaattgtgctgtgctgggttttaatggtgaagatttttctactgaaaaacaaatgctgctagacctatcctaaagacttctgatgcaatatctcttcatcagcgtgcagagcatttgttgtattttcaatacgatattcaaaggttaaatgtttttattaatagtactgggaatattttagtccgaatgccacagagagggaattaggataacacgacagatccacttctaagggcacacactggtaaaagaataatatctaatttctacattgaacattcagattgctttctttggggcttatgttttatttactggtgaggaaatgactctttaactatatttaaactgaggttgcatgaatatttaaagtgatggtttcaaccagaggaacattttcattatgggatgaacgacagaaaaaatattccactcgactttctctgaaaggttgcaaagctttaaaaccattctcttaaaacattgatattcaccaccttacttatgaaaataaatagactgggaataaatagcctagcactggtcctttatattcctgcattaaaaagaaaattagatagaccctcaaaatatgtaaagcgatcacctaaaggttgaaatgaatctagtataatggccacaatgatatcttacctgttcttagaactttatatgcactgcatcctcaaaaccactcagcaaatggattgttgctattatgcccacttggcaaagaaggaaattgaggtggagagacattagataattgcctggaatccaaatttaagtaaggcaaggagatggattaggtacccaggtgggtctaccgagtgtgagtttgtaactatacacccaagcacagaggaattctctcttcttcagagaggaagaaaactcacatccgtaaatccacaagatcagagacttagtacaaataattgtaaaatcatttattaagcacctgctgtgtacgaaaacacagagtaccatgagaagaaaattgtacagagctaggcaagacaggactcctttcaaaaagagatgatacatgagagagaaacaaactctaataattatagaacaaacttttggttaataagaaaaaaaattttaaccaggatactacatactctaaagatgatttttagttttttactttttttttttattttttgagatggggtctcacactcacccaggctgaagtacagtggtgcaatcatgactcactgcagcctccacctcctgggctcaagcaatcttcccgccccagcctccagagtatctgggactacaggtacgtgccaccatatctggctaatttttaaaatttttttgtaaagacggggtcttgctatgttgcccaggctggtctctaactcctggcctcaaacgatcctccctccttggcctcccaaaatgccaagattatagatatgagtcaccatgcccggccttctaaggatgacatttaactattttgtttatttttgtttgtttgttttgcatgagaccatcataatcctgtcaccacaatgttgattaaaatttatacttctattttttaaaatataaattttaatttttaagggctcattgaatttaggtttgacaaatctttcttatcccaacatatagctcctgtttctggtataggtttgggtttttcccaacagaaaaaaaaagtaataaaagtaaatatgtaagacagtctaaaaactgattagtgtctttctctgtcgtttttctgaaatttagcatcgctgccaatcaactctagaaatggttatcttcaggtctaaaacaataccggactgagattcataagataagggaaaaaatacaatcatgccacataaccacattttggtcaatgacagatcacataaacagtggtggtgctataagattttagtactgtagttttactataacttttctgtatttaaatatgtttaatcacagaaatactttaatcccatatttttactttacatattctttgtttaaatatgattttaatactgtatttttactgtaccttttcgtgtttaaatatgtttagatacacaaacactgaccattgtgttacaattgcctgtaatattcattatggtaacacactgtacaggttgtagccaaggagcaataggcaatatcacacaagtgtgacgtaggctacgctgtctaggcttgtgtaagcacatgctatgatgtttgaacaatgacatcacctcaagactgtttctcagaatgtatccctctagttaagcaatgcctgactatcagattcccttttagcctttgacattaaggcatttattctctactgggaaagccagatttcgctgaagtaaaagataccaatataaaaaagtatatattcaactctcaagtatccccctaagggaaaagtactacagggaacagagaagggagtgagtgatgagaagaaccgtgggtttcgtgcccatgctgtggttggcacaataatgtagaaaataaaatacaatttcaggaccctctaaatttatgatgtcaaggagggagttaagccctggaaagtgagtcatgtagcatgcttgcaattctgcttcttagataatagcttaactctcttctttactactcttgttctgtaaatgactaggagagaccggagactaggccttccccttccaattactgatctttgttatagattaactgtctcctctatttattgtcctgtacctaactcagaccagatggtgtccaaaaccacttctcagtcatatcttaagtgtggaatattaaatacacctttcctcaaaaaataagactatgttgcctaatcagatcattgtgactgcatcaaacatcatattgaaagatgttgaaattctgttaaacttctctgaacgttgtctaaataagtgatcccaaacttccacattttgaaacactgacttccattatttggaatctgtgcttcccagggcagcctgtcctaaaccttgtgcttgagtaaaccctgtttaaactagattctgacctttttgattaaagttggcaataacgaccccccacccaaagatgtccacggtcctaatcctcagaatctatgattatgccgttacatggcaaaggaaaaatttgttgtttatttgatgttaggttgatgttatttgatgttagatttctaactagatgtgtaattttgtgttcatgggcaaacagcaagcctataacgtaattacttgtttctgtgatgattgagatgtacaggaaatatagtttatatgtttgctccgttttatttccgaattttagtattcaacacttatttacttaacatcaaataaaaaccaaatgttttggtttgatgttaagctgtagctgccattgaggctgttaatccagtgactgtgagatggggagatcatcctgaattatcaggtgggaccagtgtaatcacaggggtccttcataatgggagagggaggcagaagaggtcagacaaaaagatgtgaggactgcaccagagtcagagagaggctatgttgttgggtttgcagatgaatggaagggaccatgagccatgcaaagctgacagtccttaggacctggaaaaagcaagaaaccacctttccttgagcatctgcaggtacacaatcctgccaacagcttgattttgctccagtgagaccagttttgcctttcgagctccagaattgtaaggtaatatatttctgttgttttaagccattctccttttggtaatttgttacagcagccagaaaaaaaccaaacacatgcaaatacttgctctgaaaacactgctctcagacgttgcaagtggactcatgcttctttctcccagaaggagtcaaccttacctttctgatgctgctgtggagaactgcagtctggtgtagataagcgtatcccaggcaccatgccatggtgtagacaactcttcacacttagtctccaccttgaaagcaggggtcatgtcttagtcatgtttgtatgactgttgaatgttctgtgggtgattaataaaggttacaagtggacacggataaacacacactgaagtatttaaaaatcgagttgggtgagtaatctcaatgttgccaagactcaatcacactactccaggactggtcattagaacatcagcttggtccttgcaggagcttgttagaaatgcagaatttcaaaccttcaccccagtctgagttaattatatcctacatgttaagaagataacaagaaggttcccatacagattaaagatcgagaagaactcttctaggtaagtggctctcaactatagctgcacattgtaaatcaaggtcagcgtctggttttattgctttaagaggtggccttgacgtcaggattttacacgaagagctccttgggtcattctaatgtacagccaaggataagaaccactctttcggcttcaacactgtttttcacttaagttggctttgtatagacctaccatcattcacctaatatcaatcctaagtccaagatgtaccatattcatggaataaccactttctcttgtcaatcctttcctccttccttttgggagaatgtatttcaggtactacatttctacaaaatgtagaacatatttctccttgccaaacaatcttatattacctaaagacatgtttctgatttgaaatagaaagatgatcctttaagaaacgaagaatactcatcttagaaaatactctaaaaattctcacttcagtgttgtgaaactcaaattatgttttattaaaaaattggtgtaaaaccttgttaagggcatatgtcacagatttgcttattttgaaaataaattgtggaatatgcaaacaaaatgagtgttttattaatttcataacattctaattcttagaaagctagtggaaatatttttatcttagagaataagtattatgtggttacctgtcaagacaaaatgaaactaaatttcaaaatgtaccaaataaatgtgattgttactggctttatcaaagcatgtacattcgtttgagattttgctattattagagtatgaaaggaagacttctgcagagttgttgtattgaagtcttttatgttcctcaacatcctttcttctccaactcttatgtcatcacatctttgtggtgctttacacaagtataattggcaacaacatttcatgctgctttgcttagggcttccctgacatctcagcatgagacatctgcaaagcccaccacccatggggagccacaaatcatagtgccaatggtgccgtccttggccactgcttatcagaagctgtaaaataagtggcttacccctttgatgtctcagatagacaattttaaggtgtatttcagaggcttttcagaaggtctctgacaggattgaacatgtgcttttctggaggtggatgagtcaatgaagcatccttgtactgagtgttctctgttttattccctttgttctagactccttcttcctggaactacattcttacctaaagtatccacctagaagcttttcctgccactgttaagggaagcttaggtaagacaataatcacactatttgtttatctttcttcctcattagcctgcatgtttctcttgaagatgaagcttttaactcacatatctttgcagctcctcacaactaccacacaacttggaataaaacaggcacttaaaaattatttgctgaatcagtgaatgcatttcaggactccacttctccaagaactttgcttttgatgtctctagtttttttccaatgctaaaatgctccatctgccctacccagcattttctatagcataatcaagcacttaagtcctgttcactgcaagatgctcaaggacttaactcatattcactacttgtgtttcagtctcaatttgtccattttacagacaatttcttgaagatagaaattcataaatttcatttcaagtaagaaaacctatgaaaatacttggtcaacagtaaaaaatacactagtgatgatgataatgatgattgtgatgatgatggtgatgatggtgatgatgatgattgtgatgatgatcgtgatgatgatgatgataattgtgatgatgatggtggtgatggtgatgatgatgatggtaatgattgtgataatgttaatggtaatggtgatgatgatgatgatggtgatagcaatgatcatgatgatggtgataataatgatgatggtgatgtttgtgatgatggtagtaatgatggtgatggtgatcatgggtgatgataattgtgataatgatagtggtgatggtgataataatggtgatggcaataatgatgataatggtgatgatggtgatggtatgatggtgataatgatgatgattgtgatgatggtggtgatggtgatgatggctgatgatgatgattgtgatgatgataatggtgatggtaatgatgacggtgatgatggtgatggtggtgatgatgacggtgatggtgatgatgattgtgatgatgatgatggctatgtaaatgatgataatgattatggtgatgatggcgatgatagtgatggcaatgatggtgatgctgattgtgatgatggtgatggtgatggtgaggatgatgatggggatgaaggtaatgatggtgatggtgatggtgaggatgatgatggggatgaaggtaatgatggtgatggtaatgatgatagtgatggtggtgatggcaatgatgataatgatgattgtgatgatgatggtgatgataattattgtggtgatgacaatgatggtgatggtgataatgatgatagtgatggggatgatggtaattattatgatgatggcaataaggacagtgatgatgacaatgatgataatgtgatgaccaacagtcagacagcctatatttaggataaaagctgagctcacagattagcagacttccatagttaattctttacctgagggtgggtcacaaagcaaggtccctttctatgcaaggcagagggaagtcggcatgctcaattccaatttactgaatttctatagcaacaatggctgtattgtttgaccaccatcaaatgttatcctagttgtagtccatgtgtcccataggaaggcaatctatgcattcccatttacatctcaaactgtcttatcaaaggagattctagcacttttagtaaatcctgtcatttgcaaccaagcattatgctaatctaaataaatcaggcagagaaagacaaatgcatgatctcactgatgtgtggaattttaaaagttgaacacataaaagcagaaggtagaatgatggttaccaggactggggagtgggaaacttggggagatgatggtcaaagggtacaaactttcagttattataaaagatggacaggttctggagacccaatgtacagtatggtgatgatagttaacaatactgtattgtatacttgaaatgtactaagagagtatatcttaagtgtcctcactacacacacacacacaaatgctaactatatgaggtgatagatgtgctaacttgattgtggtaatcatttcacaatatatacatatagcaaagcatcacattgtacaactcaaatgtatgattgtttttcaatctacctataatactgtgtccttattttgctgtactctgtcttctaaatttttataatatttttattaactctactttctcatgtttcattggaaaataggttagatatatttatgtggtcctgtaatggtggctttaaagtatgtatggatattataatttaaactgcttttctgcttctaatatgtcattaaatcttgtagctttatgtttaaccattaactagtatgtagaagttcaatgattgtacagtggcaagaccctacctcctcttcttctgatatatgttaaacatagaattaaaggaagaaaattttaaggtgactatccattgaaggataaaataataggtcaaaacagattaatttgaatgtcattaggaacaaatggtatgaaattcaaaatccttagtgatgatggaataattttagaaaaagtacagtattattttattatgagattaacttaaatatatgatttggcatgtgtagagaaaatggccactattacagatttacaggaggtaatactttatagaaaagtaattgcaagattaggtgtgaattatgggaacaacataattattaatcattctacaaagcatgatgactcttcaaataaatatcatgttatttatgttctacttttagcacatgtgtaactgcttttgctatctgataatcattatttgttattactgaaaacttgcttgaatttggcatatttatttttcccccatttcttcctgacctaccttttcctcctccttcactttatttcctgccttcatgcatctgaaactagatgactctctggggggctaaattattatgaggtggccatgatatgagaaaggctgcagcacagagggatactccacatttgtattcagaaattcttcaattggaaaaaaaaaagtttcttctgttttccaaagaaagtgagcaatttccagaaaatcccccgggtaaagtgatgcctgaagcgtcttgataaaaagctaaaagaagaaattttagaaattaccaaatagaggcttttgtaatgtgctatgaggttcactcagaaataacactttgttctacatttaatagcagggccattcagcatcatgcagatattgcacttggaaggcaaatggtttatgttcatgacatctgtgtcgttttaaaaaatggaattctaaaacttatgagatttgaggttattttggaaaaaaaatagtgagtattgtctggtatctatgatgatctggtaaagtcatgataatgtttcttagaatacgtggcagataaagcttaatgccaaagacacacagttgagcagacagcttgcctcttgggtcttggataaaaaactttttgtcctgtaaattattcttagcgttatcttaccaagaacttttttttttttgccttttagtttctggttccatatgaaaaaaaaggctgtatattgtaaaagctcactttggaaactttcagctaatagagacttcgggattaaagatatcattaactataacccacaggagaattcttgtttttaatgtatatgcccacaaagccaacaacgctggtttataaaataagagagagtgtctcattatgagctcaattttctataatctgacactgtatgaatacagttcaagattgagatttctttcattataattaaagaaaaatactctgaccttttcagccacactgagataactagaagcaaagtttatttcttaaaacatcctgcatatgtacatttattagagatgttaatactatgagccatatttcactctatgatgatcacaaaaactttgagcaaaacagcacagtcattatctggattgatccaatgtattttatttcataaaggagtacaggtacattttactgtacaaccacattctcctgaatctaggcagtagaaatataggagctggaggtaaactatctaacatagttagcagaagttacatttccttcaaactactcatggattacctaggacaaattatgattcattctttattgtaacaaaaataatcaatttgtatgtagcaaattattgtctatggctagtattttagctattatttctcctaatgtagatttccaaggagactatatgctcactaatatttggaaaatgttgactagaattgaaatagcaattttggttcctaattttcttgttactacatttgcggcattcctaaagatatcacccacttagaatggatgacttattttattaagctattctctccgcgagaaaagaggagtagtgaagctgatatagtacacttcatgtttccctctcaaatcatatgaaaaaaaggccttaagtggtttaaatagccacacacacgaagaatggcctataatgagaagcattgcagtatctgcagaggccactaacagagaatgacacaaatttacatacaagtatacacaacaccctgaatctgattttttaggtgttatgacagtgatttatggagaaggacagttggctctgaaattaaccagacattattataatttactgtttttgtcttaattctttatttttaattattatgggtatataaatgttgtatatatttatggggtacatgtgatattttgatacaagcatacaacaagtaatgatcacattggggtaattgaagtatccatcacctcaatcatttattatttctttgtattgggaacattccaattccactcctttagttattttgaaatatacaataaattattgttaactgcagtcaccctattgcgctactaaactctagattttattccttctatctaactgctatttttgcacccattaacaatccccattttatcctcccctccccattactcccctccccagcctctgataaccaccatgctactctctatcttcatgagttcaattaaaaaaaaattagttcccacatatgagtgagaatatgcaaaatttgtctttctgtgcctggctcatttcactttgcataatatccttcagttgcatccatgttcttgacaatgacaggattttattattttttatggccgaataaatttcattgtgtatatgtgcctcattttctttatccattcgtctgttgatagacacttagcttgattccatgtcttggctattgtgaatagtgctgcagtaaacatggggctgtagatgtctcttcaatatacttatttcctttcttttgggtgtatacccagtggtaagattgctgcttcatatggtagttttatttttagaaatgactgttctctatagtggctatactaatttacatcccactaagagtgcacaagtggtcccctttttccacatcctcaccagcatttgtgtaatttactcttatgcaagcttgacagactgtgttcttttatttattctttctacagtatttaagcatcactactgtgtcacacagagtagtaggtttgaagtataagaaaacattcctggtttcaaagatcttgcaatcaaataagaaagatggacaaataaatgaagggtgatggtgtagtgccatggcacctggaggaagaaactgccataagatgctggtatgaaaacttcaggatgcttggatggattctcaccttatcccatgtcccatgagaagcagatgtcaagacaagagtaaacatgcaggggttttattctgtaaaatgccagtgtaagagaaaataaagagacagccatttgcctcttcttctctctcttttattttatgtaaatggatttgtccaatgggtgtttcaggaagtcagggaccccaaacggaggaaccggctgaagccatgacagaagaccatggattatgaagattttatggacatttattagttccccaaattaatactttggtaatttcttatgcctgtctttactgcaatctctaaacataaattgtaaagatttcatggacacttatcacttccccaatcaatacccttgtgatttcctatgcctgtctttactttaatctcttaatcctgtcagccgagaaggatgtatattgtctcaggaccctgtaataattgcgttaactacacaaattgtacagcatgtgtgtttgagcaatatgaaatgtgggcaccctgaaaaaagaacaggataacagcaattgctcagggaataagagagataaccttaaactctgaccgctggtgagctgggcagaacagagccatatttctcttctttcaaaagcaaatgggagaaatatcgctgaattctttttctcagcatggaacgtccctgagaaagagaatgcgcacctgggggtatcggcttataaacagcccccctgggcgtggcctgtctcttatggtcgaaactgcagaagtgaaatatactccagtctcccatagtgctcccaggcttattaggaagaggaaattcctgcctaataaattttggtcagactggtcgatctcaaaaccctgtctcctgataagatgttatcaatggcaatggtgcccgaaacttcattagcaattttaagtttgccttggtcctgtggtcctgtgatctcgccctgcctccacttgcctcgtgatattctattactctgttaagtacttgatgtctgtcacccacacctattcgcgcactccctccccttttgaaaatccctaataaaaacttgctggtttttgtggcttgtggggcatcacggatcctaccaacatgtgatgtctcccccggatgcccagctttaaaatttctctcttttgtactctgtccctttatttctcaagccagccaacgcttaggaaaatagaaaagaacctacgtgattatcggggcaggtcccccgataaatgggtgcctatattgactgtatttttcagttgctgtgatgttttcaaggtgtatccatgatgtagcatgcatcagtgtgtctttcctttttatagccaaataaaatttcactgtataaatgtatcacattatatttatccattcattagttgatgcgctgtcactccgcttatca

SEQ ID NO: 824 - DNA, 51269 bp, Homo sapiens
aaaaggccagaaatcatgtaaagagtcatttagttactttgcctgtattattttttccatataaagcctctttaaatactgttcaaacatgaatttcatggtattccccattacagagccatagaatacagctgtaaacaaagcaaaatcctttatctcatggagcttgctaaggaggtggagacaaaagataaacaagtaaataaatgcatacactgtggaggtgtgaagtaagtactataaagaaaaaaaaataaaaggaagggcatacaactccatcaacacaactatggccccaaatactttcctctgtccccatcactatggaactataccatgaattcaagttctttaaatttattcaagtttccaatgggtggcaactcatactttaacacattacctcagcaaataaaatgaaaatattttatctacttagaaataaagatttccaaaagattaaaatttttgctgaaaatagtaaaccttacattttcaatagagacagttattgttagatagaaaaagttcctggactgaaactctaaaaacaaagtttttattttgaaatttactacctgccaaatggtggtcttgagacaagtcatttcgctgtctatgagttactaggaagggcttgagctcttagtgtgtcaatgggggtgtgctgttggcattttgggtgggaatgttatgggtaactgtcttgagccattcaccacactgattatctctcttccccaccctttaaatgccacagcactctacagtcatagatataacccccatacagatcccatttccttatactccatgggcagggggcggtcagtaccaagtaagaaacacttctaaatcccttcaaaagtttcaaggtcatgaaaacaaaggaagacagagaaagtgtcatagagtggatcagactaaggagaaatagattcttaaacagaaaaaggacattagtagaaaaagtgaaccaacgtgaatttctttgtttggataagtctaccgtggttatttaacatgatatcataagggaattggggttagagcagggtttctcaatagcaccattaacattttagcctggataattctaggttgtcggggactgtctatgttttgtatgatatatagcagcatccctagcctctacatactagatgccagtagcacatccaattgtgaaaaccaaaatgtctccagaaattgccagatatccttgggagcaattgcagggaacccccccaccaagtgttgagaaccactggtacgtagggactctctatattaactttgtaactcttttgtaaatctttttaattaaatacacagacatatacatacatataagagcaaagcagttatttaaaaagttgcctgggcacagtaaaagtatctacacgaaaaataaaaactaggcaacgttttaatgcttttgactagcttcattgataaggagataacagatttaaaaaatttgtttgaaattaagaaagctgtattcaaatgcaagatactggtacccaccagcataaggatggtattaatagttacctgaattttttaaaaattctttgttatacattcagatgtaaaattatttattatgatgacttccatcgtactagtttcttaagcatcatttctctaagattgatataaagagaagaggtaaatagttttggctgtttgtggtcttcttcaacaggacaatgttgtgtccttcctacatgatgtttctgcccaaatatgtaactcgtctcaagattctaagcaaacaaaaaggtaacctaatgttcaacaaatgtcaccaacagatatataactctacagacgtgtttatattttgttcacatacaggcagttgaactaagaattaataagcccacttcccacagtagcaatgttgtgggaagggggccaggggaaagcctagccctgctctgaaggcagcaaaggctgtatatgaagatggagacacactctgggctgatacttcctacttgcttggatgatgctttcagaaactaactgatgtcttggcctccccaagagtaagaaaccgaggtccaacaagagctaatacccaggcaacagggaactgcttctactctggccattgtgtgccaaatccaccatgggagcatcctcctgtgggactgaggtgaaaaagagaaagaaattggggggatggggggacatggttttcttgtgtccactgcacctcaatagacaggcctctggtttaagagccaggatgttaaacatgcttcattcactcacaactatttactaagagctaaccttgattagccagtatggttagggatatggttaggaaaagagttcctactacagcggccttcagattccgtgccccatcccatgcaggaatttagtgatgctaagactcttgaaaaccaagaccagagtcttgagtccaccagagcattaaataccaaagtggaagccagtaacccccacggtggcagaatttgcacatagttccatgccctatgtgagaatagacccaggacatggggaggacaaagatcttctagatttcacatggcttgtctgcattctttgtcaggagggtctctaatccctgccctgatttgaacttcatgatctccaagcaaagagcacctgttttaatttgatcagttgcagggtcactagggagattatcaaatattttgtccatttgcagcagatttctcttgtgccctgggacatgaggacatgagtcccaagtctgtcctgtgctgtaagcccccatattcctgaagcttggcccacgtggattcagcaagtgattggggggaaaaatggatggatgaaagaaggttaacatctcagtgcttctgacattattcccagagagacaaactgaggaagtaaattggtccagggctgtaataacagaaaagagaggcagggagggaaggagattactttcccgaaactttatctactcacctacaaatactcagacaacaaaacaaaacacagaactctctggcaaaagaagaatcctgaatatactgtagatgaaagtagccaagaagaactgtaaatgtgaaggcagaaagttggtgctaaaaaggaagtaacatgaagaatgactgcacatagttctgtaatttatgtattaaggaaccaaaggatacaaatttcttccagttatagattatgtgcaactaatgtgacttctccatggcctttcttccaaatgtgactacattgaatgtcctccaagatttgtacagaatgaaaaattgatcaacaagcatttcttgagctaaacatgtctttttaaagcacgttttgatgtcataaagaaactgaaatgccattagcacaactaaataaaaatcctacattttcaagattttaaatatgaatgagtccaatggaattattttttgttgttgttagagcaactcagcgaaacaaaattctaatttattgttcatcatattgtttcacacatatgtcaaagaggccaaaaaaataaacagcaactttacagacaaaaaaaaaaaaaaggcagggaggggagtgagaaaccttttatctttggcctttttaaccatctcatacaaacttatagtaccgctaagttcatatacaaaaaagacactggaacactcggaataagattttgttgttgttgttgttgtttttgcttttcttcaaggtttgttttttctttgaactgtatcatgaacatggtcacaccacaagtaaagtcagaagtaagacagagaaagctctgaaggctggtttgatcatttgaaatcattaaaaatggctgacccctaacaatatgtacaaaaatatacaatgaaaataaaaaatattgccaggtacagtggctcacgcctgtaatcccaggactctcgaggctgaggcgggcagatcacctgaggtcaggagttcgagacagcctggccaacatggtgaaaccccgtctctactaaaaatacaaaaattagccaggcgttgtggcaggcacctgtaatccttgctactcgggaaactgaggcaggagaattgcgttaaccgaggagatggaagttgcagtgagccaagatggcgccactgcactccaccctgggtgacagagcgagactccatctcaaaaaaaaacaaataaataaacaatgtaaataaaaaatatgaacaaatttttttcttgaagtacttttaaggaaaaaagctgagctttggaagtttggggttttttttcctcccctgttgcaaattcttgtggtttgggttgggtgttgaagagtgcttgcccggcaggcctctctacttcaagatgactacacttagattctgaaacagggtgaagagtgaatggatcacggtggccttttctctttttttcttttttttaatttaacttttccttttttgctgtctagtcaacctcatcagtcttctgcttcttggtatcaacgttgtcatcctcagcatcttcaactgcccatttgcccatagcatcctcagctgccacatcttcatcttcatcctcttcctcaccatcaccttcttcctcctctttttcctccccatattcttcctattcttcttctacctcattgtcagcctcctgtttcccattttcctcattagcgttcccattaccaggaccatctcttcccttctctgcctcctccacaacttctttcttctcctttaagactttggtgatgatcttggagctggtgtccacagttgcatctgacatggtggggcacaccagtgaccaatgcagtggactaaaaagaaaccgagagtttggggactggcaataatgcagagtccgagaagggcaggtgtagctgcagcaagctggaagccaaacccaaaaacaatgcaaatatggcttttcagagcagccagtgggctggtggaattatttgaattcactttaataatcattttgaccaattgtttttaccaagaaattatattaattcatacataagtaacttctttcagcaaatcatgaaagagaggtaaaaatgtttactccttttcctcaagtgtggaaagccctggtctgaaggtttctctaagaattggatccactgccatttttcatcaatggcgccagacagggccaactgcctccaaagagtggtaagaatctggctcttgtttctggaaatcaaaaggactaaataggcgctgggctgctgttttacaagcacaagaccgttaatccccttaccgtggatacaacagcacgttgttcctttttagatcacaagacttatccttgaataattaggcagaggcagaaatccattatatattctacaccatttaactcagaaagagaaagccttgcctgagttagactttatctttcttgctaaaaatgataaattatctaaaagttgatgtttgagtaaactaggcatattaagtttccagttgacctgggaattagactaaactttggattagattatagcttccttagaaattcctttcaacattttaaaattcctgtgaaactgttttagtaaatctggcctaaatcatattttaaacagttgaaaacacttggttgccatcttcaatccaagttccaggaaaacctcaagtaacctcaactaatgaaaccagagctttcccttaacttcatttttccatctatctcccattctgctcctaaaaaaatacagcaatagcaaaaaaagcatttaatatcagaaattgtgaatgatgattttgaaagagttgtcttgttgctgtcacatttgatctatctttctacaatgtctaccagggctaggttcctgggtgtggacctggtgcagtgtgggacctggtcttagtcctcattcgaatctcagtgctcagcacgtagcaggctttcagtagaggtcacttaatcctgtggctccagccacagcagtgtagttccacgggctggcctcatggacagcagtgaaggaagaggttgatgttgctcacactgttccctttgggcactctgtcagctccttcttcctcgcctcttgacagcatctggggcagatggtgtggctttcctgtcacttccggctgctaaggcatccaggccagtctaaccaaaactgccttcctgcctctcacctacagctgctctccttccagcagttctggccagagcagggacctgagtggtgggctccagccatttcctccgggctccactccctactccctccctgcctgtgctcccctccaccatgcttcattctcctcgcttagggacaggaaagcaagatgatgggggcgtgagatagataaggaaaggccaaattattcttcctggacctgggtccttgtggttcccccgctttgagaggtcttctgtggtagtggacgtccagatgctctccactcagaatgctcctgtggggccttcaagggcccctccagggacctctgcactgcatcttcccctgacatgggtgacacgctgactgatttcctccacctcgcctcggctctgcctccggggtgtacacctccagcctcactctgctgccttgccttgctctgtctcacttagggacatgggcccaataggcagtaactctatcctgttcccttccaaagcctctgcttggccccaggaatatattcaagtgcagactgctcaaaaaactgctctctctctccccagtcacaggtactcaagccagccttccaccatgagacttctctggctaagaagtagccaccagtttctgttccagatacactctcagtggctagggacaccatcatattctctagagctccagctactgttactctagtggcaacttgacggagtcctgagaatgtctgcaagttggggagcatccctccagaaaatattatgccagtctcctttcttaaagacaactgtatcctctatgagcacttctctacctgacttcaggtaggtagggatgcaaacaagaatatcactccaacacatcatcactcgtaaggaatggggaccaactcatcagcatgaactcagttgtcaacaccctagctggccgcactggggaatctgcacaggaacccattcccagccctgttcaagtcctaggggagtggaaatgccacagccctctctgcaagcccacaccctcagcctctctgatccccttagggaatccctggtttctcttccactgcctgcctgcggtgatggtaactggactagatcagctctccaacaagacatcacttcctttttcatagccatgcaagcttctactgtaagtatatgccaattgtacgtttccaaataggaagaggcatgctcaggagacaatgagctctgtatcattggtggtgaccaaacttgatataagagatgttgtagatatcaccctgggtaaaaggtgggatgaaagtgagactattcattattctgttaattacttgaatatctttatttttaattcacgtgatttggtttatttttgtgctttacagttttctgcaatattagtagataaacaatggtgggcgggggggagacaataaacagccagtcccaaaacttggatcctgaagctatcctggaaaggaatatttgccacactccttcagtctgcccacattggcaccaaaagatttctggaaggcggctactggtatcttccatccacctgccacactggagagaagcagcctctccgcaaagctattttcaatccaatcttgcattatgtggtgccctttcccatagctcttcatgtaggggtgcagcttccaatatggcagtgcatgtggaatccaggccagcagctgaattgcatcttaaacacatctcgctcgccaattcatccccttgatagcagtattaccaggactcatactgcctgactctttacagaaaaatgtgtactgaccctcagtccagttttgcagttttgatttttacaactgacactggcaacaaaagcttctacttttcttgaaggtgccattacttgcaatggcaaaaaccacaattactatttcaccaacccgacatatatcctgtgtacccaatttttttttttttttgagacagagtctcactctgtcacccaggctggagtgcagtggcaccatcatagttcactacagcctcaaactcccaggctcaagtgatctcagcctcctgagtagctgggactattggtgtgtgccaccatgcccagctaatttttgcattttttgtagaaacgaggttttgccatgttgtccatgttgcccaggctggtctcgaactcctgggctcaagtgatctgcctgcctcggcctcccaaagttttgggattggaggcgtgagccactgcacccagccccagtgcccaactgtaagtcaaacaacctttcaaataaaccggatcagatattcatagactcctacaatgctccagattctgaaggaagatattttaaaggtaaactcccaaaaatcaatctgaaatgttatatacttaaattaaaatttcctaagaatggaaacacttaatttaacttagtcatgtactaggtgaaatgtgatcatttaaaggaactaatagtgccatgaacacagcaatgtataaaacttgcttacaagaagggctagaagaaaatacaaagagaatatttaagaggttaccattgtgagataaccagtggcttttcttcttattttttttttcctgttcaactttttgtaatgtaatcaccttatttttattgaaaaaagttattataaatagttgtgaaagaatgctgcagtttaatggcatgaaatacaatatatataattttaagatctataaaacaggagtagaacttagggcaaagttttgttttattatataccttcttttcattttttgaatcacgttaatatattattttaaaacatatatttaaaatatacatgtgtgtatacacaaatgtatatgtgttcattttgctccctcaaattccactcttctgtttcattctttatattcatatcccatgcatcagatattgtggatgtgagggagaccaattaatagtaatcatctatactgggccttgaattattatagaattaagacaaaaagattgtacagatgggagaccaaaataaaaggttaggttggaggatatgactttaatcagcaggcagaatttctccctaatttaaaaaaaatcctgaaatgaaatatattcacctccattgtctcaagtagagcataagtgaggcaggtattgtcctgtactggagtaatacacaagatatttaacccttcatataaaatggcacctactaaatgctcctcagctgcaaacagcaagtacaaccttagggtgtatgcacctgtgcatgcagggcctggttctgtacttagctagagagttgcatgagagacgtctgctatcatttggggatggctacctcacaaggagaaaggaacccatgcccaggttctccttccagctcaccaatcacataagtcattttacctctcaagggaggagtgaagaagggaatagagaaagaccaggaatgttaccctcatcacaaatagagaaagaaagaaacatcatagagaagattcctccagaagaacagacaaaaaatataaaactattaaaagtcatattaagtgcttttaagaaaataaacaaggtactatgataaataccaagagtggaaagaacttatacacacttaggttattttcaaaataagagtaaaattctttggtatctatctgcaagaaaattatatatatatatatatatatatacacacacacacacaatagaaatgtagaaagcttaggatatatagctgcaattttgagggatatttatcttcatattatctattaaacaaagagcattgttggaacatgatataaactgtaagatgagttagattataaaagttatttttaagtttaataaaagtgtgaatccctttgaaaaattagcttaataaattattttcaaaatcaaggtttgaaataatgcactatctcaaataatactgtaaataatcagttaagatttctcattatttgcttactctgttgcttctctgttgggaacttttctcatggagaaagctaccatcgctttgaagaggtattcttcattggtatcccaggcatactgaaaaagaaggaaaacaaagtgtatgggggaaaatatggtccattggttctacttgtacccacagtggctctccctctctctctctctccacacacacacacacacacacgcacacacacacacgtttctcatatattagatactggagaccacgataaattatatccccatgtttggggtagggtttcttggacattctaagtttggtgtgtctcctgttgcactatcttcctaagaacctgcagcatcagtacccagccaacaaatagggcatttggacatttcatcctggccatatatagtccattttcatttccttcctccctttctcttttccctcataaactccctcccagttgcctttattaacatcagtacaatttttaaaaaattttcttagccagaaactttagtgtgtgtgcgtgcatattatgggctgaatttttgtcctcaccagaaaaatttcatgttgaagtcctaacttgcaatacctcagaatttaactctatttggagacagggtctttgcagtgatgattaagtcaaaatgaagttgttggagtgggccctaatccactatgattggtgtccttagaagaggaaatctggacacagagggaagatgatatgaagacacagggagaagacagccatctacatacaggccaaagagagaggcctggaacagatccttccttcacagccctcagaaggaaccaaccctatgacatcttgacttccagaactgagagaaaataaatttccgttgtgtaaggcacccagtctgtgttactctgttatggcaaccctagcaaattaatatagtatatttgactcactctgctccttaatgcagtaaatgcaaaaagcctgaggcaaaaagaaactgagctgtttaaggaccaccaaggagggtagcaactaaagagaagcaggaagggagaaagtagcaaaagctgagcggaagaagttggtgagggtggggggttggtatatcacaaggacattgtcaggattggggtttcactctgggatggggaaacatattttaccgttactgcctttctcctctttggtggcagggaggatagtaagtaaaaataaatgactcctaaataacaacaacaaaaaatgtattactcagttaccttctctgggtaaggtttatgactgtgctgtactttttcctttctcctaaatattttcatagcatattctttttttggaagggaggagggatggggtcttgctgtgctgtccaggctggtctcaaatgtgtggccttaagtgatcctcctgccttggcctctgtaacatagaaccttaaactttcttcagttgcttcttccacttcaccattttctccttcagtcctaccttatgtaactctgctgtaagatgttaccataaagaacagaaaagggggacaggagtggtggctcaagcctgtaacactttgggaggccaagatgggtggatcacttgagcccaggagctcaagactagcctgggcaacatagtgaaaccccatctctaccaaaaaaaaaaaaaaaatcagccaggcgtggtggcatgcacctgtagtcccagctacccaggaggctaaggcaggaagattgcttgaacctgggaagtggaggttgccgtgagccaagatcatgccactgcactccagcctggatgacagagtgagaccctgtctccaacaacaacaacaacaacaacaacaacaacaacaacaaaagaatggaaatggaaaaatcacttttctcatatgcaaatgttaaatactgcattttaatgtcaactttagatcttatttgaagtgctccttcaatgttttgatgtgaacttttcatttgatattatactatgaaagtttaaaagtaactgattggtggcatagctctttgtttttgataatgcatttttttccaaaattaattttattcagaataagagtagctatgatctaacctaataataaatgaataaaacatgaagaagaaatgggtctgattaaaaatggtgcagaaacactattaagacagggaaggcttattaacagaatgcagacacaaggaataagcctgctcaagaacaaatgagaataataagctcagtgcagaaaatgaaaataaagatgttagccagctctccctgggacatgaatttcagttgcttttcagatcttggggacaacttgacctgatctcctgtccttccatttgttcatctcaaaaacaagagcataagctggctgggtaggagtccaattttggtcacagaacaaaggtccaagctacttagatcagaacagaactgatgcagttctagattgggttgggtatcctgccagtggaaccaacttatcttgggcaagtgtgaaaaggattgaaagcttgtgcattggacgtagtgtatttctcccagggcattcaaacacttcaaagagagagcctccgcttataaaaggaattgagcacatatattaatgagaaaatgtacaacttaagagaggataaggtaagagttactaaagctaaacatttgtatactttatgatccattaatctactccagggtaaatacccccaaaaaagaaggcatatgaaaaatacacatataagaatgtccatagcagcttaactacctgttgtgcgtatacttgacacataataggtgctcaatgtgaaattgaacacatctttatatgccacgtgtggcttcacagaccaaatggtacaaattaattgcatatatttatctatcagtttagattccttggttcctcatttcaataacatgtgccaggaccttaaatgccccagctcaccttgctttttgcacacatctaagaacactcaaaccatggctaaccccacattttaggtaagtaactggtataactagagacaattacagaacagggttagttggtttaactctaaattcatgatgacctacccccaaattgcctgggaatccctaaggtttcaccatcagttctctttctcatgggtcacataactatttcaaacctctctctagagagagaactgatggtcaatgctttttttttttaaccatttttcccaatggtttccctcaaacctcactctcactaaatggttttgcttcataatttatagatacatctcatcaatttcaactctcccaacctcctgacatcaagatacaacacttcctccatagacacgtcttagccgcctcctctcctgaagtgccagacagaactatgcctatcagaggccatttccgtcacttatattaggaatgcttctcctctgcccttctcagatctaaacaatatcagttcccctccattctgtgtatttagctctgaccggagtctgttcattgtcttttaaccaagctcaagactttctcattaaagccatagcaaagagctgttgttttgcaacagcaaaaacaaatcattttactcagtcttcctttcttctacctactgctatctctttcctgcccttcacagccaaaattctcccaggagttgtccacacatctgtttcaacatgttcaccactcatttattttttaactccccactatctgtcttccagctcctccaccccacgaaaagagctctttctaaaatcaccattgacctccatattgtccaacacaatgaacatttttcagtcgccttctggcttggcctctcaacggcatttgatgctcttgaaccctccctacatctcaaaatgaaactccctaacacagcccacatattccttggcctgcctgctcctctctctttaagctcatcacctgccatgttcctcctcactgccccaattccagatatttctgccctctttctaatctttactctcaccaagatccttcctgtgataagcctttgcacatgctgttccctctgcctttccttctttcatttcctgtaacacttcaactcatgcttcagacatcacagtaagtgccaggtattgtgggccttgacaaagccgaagtgcccttgtacttcttcccgtaatacttgtcaagattgcacatttgcatttggtttactgaatatttaatagatgaccaattctactactactataagctccacaagggtaaggacaagccttaatcaccattacatcccagcattcagcatcgtacctgctattagaggatactgggatggccaaccctgcacactagtagagacagtgtattctgcactcagactgcctgggctcaaatcttacttctgccacttgctgacttgaaatattgagcatgttacttaatttctttgaacctcagttttctcatccattcagtgggaatactaatacctgtactactatcttcctcaaagcattgttgtgagggctaaatgatttgataggagtaaggtgcttagaagagccccagctagaaagtaagataagttctcaataaatgctggctgttataacaatcattactcattgagtcaataataaaataccaaattgatgaactggcctgcaaacagaatacctctaagtttctttagcactcttttttctgtttctatgcctaaggcatcttaacgtcaccttctattggggaaaaaattttgcagaccacactaggaaactgaaactagaattagacaatactgtctttttaattcaatgatctttaccattcctatagccacatgggccctatgactattttttaaacttctatttcataagcatatatttcatatgttactttgataattgagaataattgaagaaacttcaggttcaaattggaaattttttgtgctatgaaagactttatgtgggtagaactatcccttattttcaatggtagaaaatcgaggctaacaaaattcaaatgaccacaacggtgaggagtagacccagtccagacctgaacgactgactcaggccacttggcttcactatcccgagttgagatgctggttttttaagttgttttgtgtggcacaaaacttcacatgttgcctagcatacactactgattaaatactttaggcaaacctactttattaaaaattcatattattctataatctatctttaagaaatcagatttgaggtctttagaaataatttattcaagattaaggtaactatgcagacaggcccattattagagaaagcacagtgttattagcaaacaaaatttaaaaagaacactcaggtgctccacttactgctttatctcccagagctgttctgatactaagtctcactttaaaagcattttctgcacctgccagaaaagaaaaaagaaagagcagtatatgatgattaggatctgccaaaacagagtctgaaaaatcctaatatgtaatgcaactcaaactaatggaacaaagaactacaattaaacagccccaaatactcctggaagtttaacctaaatcatcttagatggtttaatattttctttcaaactcattaaacactcactgccccaactttcaagccacaacatgtctgcagatttagaaaaataaagagttctttcagtcgatgacttgtcaaacatgtagaaaactgttcatctatttttaaatttcaaggctacatacctggttgacagagttcagcatgaatggcagtcaccagaaaaaagagcagccacaacattctttcagggtggaaaacacaaggcaaagtgagaaaaaaaaaatccacgctgcacttaaatctgccttagccattctgtgacccggattagaatatcagagaaacaagcgagccaccaccaaaaaggtttaatgattaacacccatcatttgggttaatacttccataaaaacagcccatctcctgtcagttatttatgaaaacctgtttggaaaacagattagttgttttccctactctgactctacctcaaaagaatgtcttctttgctgactcaaagttggaatcctccccgaccccttctgcgattctctggttacgtgtatgatgggaagaattgagtcctgtctagaggtttccttgacatgcacttcccaccttttcgaggctgagatacctggttcttagataggctatcttcattcaggaaacaaacgtgactcccttctctctggtaaacaaagggtgccctccgtgaagggcctcacctgactctcaccacagcgggtgaacatcccaggagagcttcggagcttcctcttacctacttaaggttagagggtgggaggagagagaggatcgaaaaactacctatcgaatactatgcttattatctgggtgacaaaataatctgtacaccaaactccagtgacacacaatttacctatacaacaaaactgcacaggtgcctgcacattcacacatagggaatgattgtgttcagccctgaggtctggcacttgaattaaatcaaagttaatgatacagagcagcactgtccaagggacattctgtggcgatgggaatgttctgtgtctgtactatccaatatggcagctactacaggtaggaggccattgagcactggaaatggagctagtgtagctgagaaatggaatttttgtttaatttaatttaagtaggcacatgtggctactgactacattggtcagtacagcaatacaacagtaattaaaagttacccactctgaagtaccttcactgggttatttctctgatcctcagacacttcacaattgttatcatcatctcatacgggagggaactgaggctccagcgttgaagtcattggcagcaatgggatgagtgggatgggtgtcactttaccagctaggttgacttacacttgaaccctgtctccaccacacccaactgctctgtgtctctggtcaccattggtcaaaattggaattgatcaaataccacagtctcactgataagtgggagctaaacattgagtacacatggacacaaagaagggaacaacagacacaggtacctacttgaggatagtgggtgggaggagggagaggatcgaaaaactacctatcgaatactatgcttattatctgggtgacaaaataatctgtacaccaaactccagtgacatacaatttacttatataacaaacctgcacatccacccctaaacctaaaataaaagttttaaaaaaccctgaagttgcaacaaagcctcagagatgctctgagaattaagataatgcgtgtaaaagaatctttccccggtgggcattccacagatgccaatcaacgccccgcccagaggttgatgtcaggactttcctctctaccatgctgcctcttcataaattcagtccccaaattccaccccattcctcaaaagtcatgaatggcagaattagattgggtgactctggtgttaaatagaaacattggattttcaaagcaacaacgaggaaaatatcaacaatgagacttctgcagcactttgagaaacacatcatttctccctccttgcgagggtggtattttattgtaaaggacccacatccatcagctaaatccaactgagaaagctttttctcatctccttcaccttggttgcaaggacacggagtcaggaaaagctgtactaaaaggagagggagccacaacttagtccagccatcctagcaatgtcactgtattaggtgcagtggaaatttccagaaggaagagctcacctagctaacatctgaaaaaaataaagccagactagatgaagtcatcttgggaaatgttaaactagataaagtcatcatgggaaggaaaagtcaatacacatagagattgtaacaaagcattttacttacatcaaggaagaaagctatgctaagaacatagaaatctgcttcagcggctgggcacagtgcctcacacctgtaatcccagcactttcggaggccgaggcaggtggatcatgaggtcaggagttcaagaccagcctggccaagatggtgaaaccccatctctactaaaagtacaaataattagccgggcgtggtggcaggtgcctgtagtcccagctactcgggaggctgaggcaggagaattgcttgaacccgggaggcggagcttgcagtgagccgagatcgtgccactgcactccagccggggcaacagagcgagactccatctcaaaaataaataaataaataaataaataaataaataagaaatctgcttcagctttcctttagccttacacttcataaaagtatcaagtggctttctttggcttttacttagtcattgatgtaactcgggttgaagacaatagaacactgagtcttagtgtaagtcattcatttgagaagacaatctcttttgaatgatggtttctcaatgtttgttgtatcatcttttcaaaaagagcaatagaaattctttttagaaaatacaaagcagcacaaggagaaaagtaaaaatcacctgtaattccatcagcgtcaacgaatgaccaattgtcaatgttttctaaatatttggaacatatctttctgccttgtgctttcttttttgtgtaaatacatgtacatttcttcttaaaaacaaaactggggtcatgctattatgcagctttgtcatctttgttgaacttaactgtgttttgttgttgtttgttgtttttttttaatagagacaggatcttgctctgatgcccaggctggagtgcagtggcaccatcttagctcagtgcagcctcaacctcctgggctcaagcaaccctcctgcctcagctcccagagtagaaacacagaattcttcttcaggttcctttagtcttgcatttcttaaaagtgacaaatttcttcataagcttttagtcatctatgtaactagaattgaagacagtaaaatattgagtttcagtcagtgtaagccattcatctgaaaagggaagacaatctcttatttcattatgatttctcaatatttgtgttctcatttttaaaatgattgaaaaaagcaatagaaattctgtatagacaatatagagaagcaaaaaaaagtagaaaacatccataatactaccagaatggatgaccaatgctaatatattttcatagttagaatgcgccttccttagccttggatctctttatatgttcttgtaggatgttgttttttctcactgcagtggcactatcagaacagagtaatacaatgatgggaataagacgcacccttgtcttcttctttactctaataggaatgccactactgcacggaatctggcaagtggctttaaaaatgatgtgtcatgtgatacgagcattatatttgtaattacaaaaaattattttcctcagtaattggtgttgcattttatcaactgcttttcactattaaaatttttaccatttggtgtattacattaatacatttttcacattgattcaattcttagataaaacatttttttaatttatttttagtatgctgctggaatcaattcctggtttttcccctatgatttttaaacctattttcttaaaagaatatcaggtaggttccttttcaagtgctgattcttgaagcgttttttttcctagcctttaccatcttgaaaatgatacagaaagatttctaacattgtctatgtttagaaatacatataatgtaccagaaataaagagttcacagatgaagaatctggaccatgtgcattttagaggaagagttcttcaaaatttttcattccttacattatcatttatttcaggttttatacctctttctgaatccattttggctgtttacaatttccaagaaaatattctgttaagattttctagtatcctcatggactttatagagtatttcccataaaatatctacttttgttgttatgttctctttatattttctaatacgtgtattaattttctcattttgattatattatctttgttgtttaatcaaagaagaagatcttggacataatttgcaattctttctgttttttgattcataaatcttatttatattggttacatactgtaacaaattcattgttaaatagtttgatggagatctcagtaaaataaatggaaaacagaactagatactagggttcttgcctctcagcatattatattttcctatacttttcaaagtcttgcacaaatttagtgcttgtcttgatgtacaagttttaagtagtaagtttccagagccttcatatctgtataaattgcttcataaaatgctcatttcagcaatttcacatatgggagcttcataacttattagtaaccatggtaatgatgacaaataaagcagttcaatcattctgaatatgttactatttacttccaaacgttcagagtttagagcatgtagatttaaaagttcagattactgttgccatgagccacacaaaagggcactgagtctcctgagatgggaaaacgaaattgatttctccgtgttttttatactccacaacactcttgaaaagcactttctgggcacataactatggatctactgctctggggtaaacagaatatgagatcacatgaaaagaaaacacatgtgtcgttcttttgattcatgcaagatcccttaagttcactagattcgtataaatacgtgggcgtatgtaggctccattcacctccaataaagcaagaggtggagatgaccaatgtttcttttaaaattgaccctggttattttgtttcattatcaaaaacagaaatttagtaaatatatagctcctaaaattagtaaactgtaaaaccatctcaaatgtgacattattctgtatatttttattggattttcagaaatgttatctggctgtgacacattaaaagaaatcaattaaaacttttaataattgaacatagaaactttgtataagattttaaaacttcacactttttgctgctgggcatggtggctcatgcctgtaatcccagcactttgggagggcgaggcaagcagattgcttgagtccaagagttcaagacaggcctggacaacatggcgaaaccccctctctacaaaaagtacaaaaattagccaggcttggtggcatgcacctgtggtcccagcaacttggaaggctgaggcaggaggatcacctgagcccagggaggttgaggctgcagtgagccatgattgtgccaccacactccagtctgtgtgacagagcgagactctgtctcaaaaaataaaaaaaacaaaaaccaaaaacaaaacacacacacacacacacacacacacacacacacacacacacaaacccctttggaagttttaatatcttaattaaatggctctactcaatgatttcctaaatgttgtagaattttaataaatgacatccttccttgtttaaattgtaatgaaatggatatactatatataataaacaatatcaagatgtttgtattattaataatttatacaatgttttcagtataattaggcaacaaaaataattttattctctttaaattgtcagtgttaagatacatggagagacaaagtatttttgtctattgtgtgtaagttctattttaactcagtggttttcaattgggggtgattttgtgctccagagacacttggcaacgtctggtgacatttttagtcatcatgaatggcagatgagaggattctactggcatctagtgggtagaggccagggatgctgcaaaacacccccacaaactttaaaaatgtcatttaggtaactcttttcttcttgtagttgagttaatggaaataacccacacaaggaagaacagaagaaaaaagggagacaagtgtgtgtgtgtgtgtgtgtgtgtgtgtgtgtgtgtgtgtgtgtgtgtgtgtgtgtgtggtttctctaaggctaagaatgtaaaaatatatacattgcaatgcatttcatggtacttaatttccagtcacaagcttattagaacttcagtttatgattcaaattagtcaactcagttttcttaaactatcatattcatgggctacgagaaatgcaaaaatgaaccaaatatagtctctgcccttcaggaacttacaattttgtaggacacaaaagtaaatcacgatggcaatagatgcacatacaattgtgaacaaaatgctataggaacactggagaaaaagaggataaaaagttactggatttgacaagtcaattataaaactgttaacaaaagaaaaatagaagaaaggtttctcaatgataatcaagatagacctggaacaatggcaagatgtttaaagataaaacatgaaagcccacaggatacaagttaaggaaatctgaaaacaaacacaaaggacagatacaggatatggccaacagcagggacttgctggtagagtggttcagaggaagatgggggagagagcatcagtgtagatgcatctgaaaagccaagttgggttctgatcttagaggtcagagagtctggattctccaacaatggtcctgagaggctaatgaagatttcaatgtgggaatgggttcattgtaaatgacacagagaaggacaatgggagatgggaaggacattccctgacagtgagtttccaatgtgccctttatttactaatcacaggctgttggactggcagcccactacgtgcccatgactacaaaaaacaggaaattatttttcattggccatcttaataaaaagataaatgagcttattttaataataattttagaatatagaacagatgatgttacaatcttttggtatgcttaattttatgcgcgcacacacacacacacacacacacacacacacacacacacaatttccagtatccttggtaagcaagaaactctataatgtggaatatttttgtctccatcacatatatcccctttttaagatgagaaatcatattaagcaaggatatttgaaaagctcatcaaattttgtaggttaatcagtagccataatcattatgaactttgtcttattcttcacaagttaacatttttctacttcagagaaagttaatcactaccgtttggaaataaaaattaattcagatcaactgagtgagtgtaattctgccaactttatgctcctaaagtagcaatttaaaggacagtttcttaaatgggaaaaaaaaagtatgtgtgtctgtgtgtttcatcttgtgcatggagaccaatgctttataatgggtctcatgtagttaaagcaagacatttcttttacaggtttagctggttccactgttgctcaggtgtaagagttttctcatgatttggcaagtcaattttctctttttactaggctaacagtattgcagccatggtctatgaaatagtattttccatccttaatcatcaatttgcccaccagttggaggtcacctagtcacatttagccctgacaacaggtacttcttttgccaacctctataaagggtgtgggggcgggggcgggatcagaccacataacttttaggttatatgctctcattaatattaaagacatatgaattaatcaatatctcagaatttctgatcctacgtttcggccagtgatgaccctgaaccctctactgtctgaaattcatcaaaagtcttatgagaaatgtttttgtggactgcctaaaagatgtgcacaagagatccctattactacaaatcagagatgacaggttgtttgcagccatttgctcatcccacacccatgacaaacattttttatctatttcagaactttttccttctgtgcatggactcagccaccccaactgagctattcagtccactaatatgaataaatgggagttgacatgtgagttgaaacttatgtgccattatggggaaagattatctaaatgctaccctgaattaaaccagaccattgtggggctgtgtactcagtcgaacaggaaattttggatggttcatgaaattgattcagtgccctgtgctttgtgattatgccaacagtttccattgagggaatgtgggtgtaacaacttatgacacttatttcccacgtagctcacagcgtcatcatgatgaggaactgggatttgccttggggctaaaaattatttttaaaaaaacaaacagtgcttctcaaaagcaaacaaaatcctgattgattggtttttatgaacaccgtaaaactttaaaatacttgttatctcctgttttctatggaagcttagagtgagatctcttgcccaccttcaaaaactgttctggatctgaaagtgtgcatacttgagtgttaatcttaccattggctacattatttattctccctccatgaatttcccctctggttccttaaactataatacttactttatacagtgttgcctatattttggtacgcggcctcaaatcatctgggagaaaataatgctataaaaatcaatgcagtaatttacacaggctgcacttgatcccatttccggtgtgtttaatttttcatgcaaaaaatgattagcattggcaacattttatataaatgagatagagttctcagagccagggtgagcttaataaaaaatgttttgttgaaaattgtcttttactctgtgctccttgtagctcaatattgtgaaagttcccactgtcttcaaagcagaaatggatggaaggtgggaagagaaaggaacttttacactttatatgtgatcataaaatcttgattactggcatatgtagaagtgtatatagtaaatctcactgccatggagggaaaaattgtaatcctctatacaagtgaaaagggaatactttaaatgaagattgagaatttattgtgaagggagctgtactaactgctatgtaagtggcttcctatgtttgctgccccaaaatactcctgctaattagaacaacaaaccagcacttatcaagtccttttccacctatcaactcctttattacaccatctttaattttctcaattcttgtgccatctaaacttgagttggggaagctcagtctgtgatctctttgactcttgtcttatttcttactggaacatagtacttgataaatctgtcttgaatgaatgaatgaatgaatggctaatggaaagtgtccatcctctaagaatgtccgttcagaaatttctggacagaaaagctggtaataacctcctcacttttttcctgtgaacccagaattgcgaatggagggagtaaaaaagcgtaatcttggagcagggggctgcaaacagaggtctgaatgtggtggtgtctagacaggacctagagagcattagggcaccaagtgcctaggaaaagtcatcaggaggacacatcaggaagtagaggagtgtgcttactccatgtatctccctagcatttaaagtccgctgactttaaatgggctggaaggaacacggttccagtttatctccatatcgggttaaaggacatgaaacctagctagaaggaacattgctccaccactggcccatcagttctgtttcctactcggtttttgcttaacgagttgtggtgtttagagttgggagatacatggagaaagtcactttttaggagaggatcagagatccgcaggctcatttcactctataaatgccgcggacatctggttccaggacctggacagtcctctctggagactggtgggcccctccaacacctccgtggcttcccgggatcaagtatcgcacctaaaaggagcgcagagagcgtgcaactggcgggagaggcgtgaccagagtggaaccaaaagtgggtggcctgggaacctaacgcgtgaccagaagtgaaggtaggtaagtgcgcatgcgcaggatgcgagtggccaatgaggaccacaaggttgtagcgtgtggcctgagaggacggccaggactggccagaaaagagaggtgtggaatgcagtaagaaaagtgacgcggaccagaggggtcttgcctgttccgagagaatggaaggggttagccacggtgggaacggccacggcgggaacggccccgccagtgaggagcgcaggcagcaaggcttagcggaagaggcgtgacccaggcgtaccgcaggggcgtggcccgaacgagctgactttagcccttacgtgaaaggcgtggcgtagtcgcaagggtgtaaaaaagaaattcgaattcgcgggacggtcggcctcaggcggagtagggacgtgagcccaagggagggaggtggggtaggcagactagttgtgactggatgatcactgggcgaagggtggaaaagtggccacagatggaaaggcgggctgcggagtagtgaccggcaagggaggtggcgcgaaaagggaagtagggacatgacgtagttggaacgcagagacgtgcctcgaacgtggggggcgcggtccttacgtgtgggcgtgccttgttgctctgaggggcgtaacaaagatggtggagcaggcggagggcagaggcgtcggcaagttagcgtgcaggcgcgtggcagcgacaggagatgtgtagccagagcgcagagcaggtgtggactccggcgctggggaagcgtggccagggcgagatttcagcctgggtcggggacagaatggggactgataggggcgtaacctggaatgacgaaatgacgtttgctgcgtagggacgtggctaaacgtgagggggcgtggccaagatggccgcgtgcgggatcctcgggtaccgggagcgaacgaggaggttctggctcaggtaagtcgttcgggtaagggcgggcggcagtaaggagcgtgggcagcagcagggcgtggtctgcttgagagggcaggaactgtgccacttgccgcaaacatgaccgcgtgccgctatcggccctggagccagagaagcttttggtgcggcgaggttggccggggccctggcggggcttctctgaggaatgggagtgggaggctggcggcggggaaatagccacttccccactctagccctctttctccgctatggggatcaccagacatccttttaggattctgtctattaaaaagtagaacagctttcccagagacattgcgggatgagaggagtgtccagaaaccaaggagcagcaagctgggactccctcgggtctgcattgttgatattcccacctgactatgctaggggctatggacagacacagccaccccagagtagatcaaaagcacagttgtgtcccttggacaaatctgagtttttctgttgtgccttgccccagagccggaggagaggaacctccaaaatgcagacattcttggtggctgggattctgtgtgatattcagcgttaaatgctgctgctctgaggctgctggaaacgcgttagtattaatatctgtgtacttctctcacatttacttttgctggaaaagcttgggaaatgacttaacgaagatgcgtaaaccttaatttgtttatatgctccttattagccactgaataccacattgctttctgcttccccttcttctttactgataatctgaccatttccactatgcactttgaaagtcttgctggagtatggagaatagtcagaaatctctggtaagatgctgccccgcgcatctctcagaggagtcactattcatagcctgcatcagagttcacaatgaaccaaagttcaccccacctcccctgtcttcagggacttagtgaaaagctgcactgttcttgaatattttggaaatgaaaaactttctgggctattttaaatcagtacctgggctggaattaaccgaaaggcgaaacagcaagggcaccattctctgtgcctatacgtagctgccctgtgcttggaaccaagcaaaaaggctgccactgctcacagttgcaatggaataaaggttgagtgccttgtgattgcatatgaatattaaggaaatctgatggaaagagggaaattcatcatgtcactggccacactggggcagttagttgcaacacacaaatcaggtataatatattttgaaacctttggcaacctcagattgggatcacactctcaaggaagaagtgagtgagaggaggaagctaagctttcttaagacatagcagcgtaatctctaatttaagtttcaggaaattgcaaaaggcaggcttccttttgaaatcaggagttgagaaaatgaagagtcaatctgatgccaatcaaggaatttttcaatataattgtaaccttttgttagtacttttcctgtctctttcgcataagttgcttaatcaggcagagttcaagctatgaggcatttaataaatacattacttatgaatgacatttaaagacttttagaatcttttcttttttcacacatttctaaggctgcaaaacaacagaaaaagaacatgttagtaatatccaaggcatacatgaataatcagtgacagcaaaggatgtgtagcacagaaggcttagctctcctaggcggtatccagccacacactggtaattgttgaaatggagtattggatatatagatgatttattctcaccatttttttgtacaagtttgaagtttgccctaataaggggaaaacagattctaaattcagttgacccatggactattgctgtttaaacctgctaagtgaattcagatagtgaagttatttaaaaaccagatgctcttacctggctgcaggaactatcaagataagatattgaaagcttattggcagtctgtcttttaaatcctgagccagacttttttacatggcttcaacaaggtgatttttcatctccttagacattttgacatacacactcccactaaaaactgtatttacacaaacacagataaaactaaacaaaagtgattttaactttggtttgagaattgtcagcaccttttaggcaacgcagacatactttaggtgtcactggctgttacgagttcaattgcaccctcccatctcaaactcatatacgtttaagtcttaagccccagtacctcagaatgtgacctcatatggagattgggtctgtataaaggtaattatggtcattagggtgaccactagtccaatataactggtgtccttaattaaaagggaaatttggacacagacaagatgagaatggcttacgaaaattggatttaatgctgacacaagccaaggaattaccagaagcaaggtttattaggtgttctccagagaaacaaaaccaattgtgtgtgtgtatgtgtatatatgtgtgtgtgtatgtatgtatgtgtgggtgtgcctgtgtgtgtgcttgtgcgtgtgtgtgtgtgtgtgtgtttagagagagatttatttttaaaaattggctcgtgaatgtaggctcgtgaaatttgcagtgcaggccagcagactggagaccagggaagaattgatattacagcctgtcttactcagttttgtgctgtaacagaatacctgacactggataatttataatgaacagaaatttatgtggctcatgattctggaggctgggaagtccaagggcatggtgccagcatctgctcagcatctagtgagggctctctcttgcatcatcccatagcacaaggcagaagggcaagaacatgtgcatgtgaggggtgggagtggttgggggtgaagaaggagggagggagggaagggaaagaagccaaatttatccttatatcaggaacccactacctcagaaactaaccagctccccctaataatggcattaatccattcatgaggggagggccctcatgatttaatcacctcccaacacttttgcgttgcagattaagtttccaaaacgtgaactttggggacacattcagactggattgtgagcacaaactggtgccatggcacagctccagtccaaaggcagtctggaggtagaatttcctcttcctcaggggacctgtctttttcaacttaaggctttcgacggattgggtagggcccacccacatgaagggtaataatctttattccaagtctactgatttaaatgttaatcttatctaaaaaatacattcacagtgacatttaaactggtatttgaccaaacatctgggtaccatgacctacccaagttggcacataaaattaaccatccaagtagaaaggcctggaacagagcgctcattgccctcagaaggaaccaaccctgcagagaacttggacctcagatttctaacctccagaaccatgagacaacaaaaatttttaagccaaccagtctatggtactttcttacgagctaatacattggcctaaagacctccggtagggagtcaagcctagaggtaaggaacctccacaggattcactaacttcctaccagtcccctttaatgtaatggctgcacatctctggctccctgagttcagcgcacattagcaaagtgatgcatatgcaaagcaaagcgcatggcactgtgccaaaagactggcttctcatcctgctgtgctttatttcacaatgcacatagagatgattctcgctcctttcacgtaggtgtagtcttctctctagcttagatggagcaggatcaaggacagcagtacagaggagaagagctagttcacagccaattactagcatgaatgtgcacaaagagaggggaggatgaaagcacgtttgcctcctttctcagcatcactgaggaccatgatgtgggttttatatcttacattcttcttggaaagatggtgtaaagaaataaagttcagatttgtaagggaaatgtgtctttagtgcccctcaacttctacatttgtgccttttgccacccattcccacctaccccaacccccaccactaccccaccatggccatactgctgagagcccctcttttggcaagagaaggcagaatctgaggtggcaaaaaacaccctgctgcaaactggtttgctctgtgtttctcttacccatactatgtgcatttcaggaggctcctaagggagaaattacatacctggaaggtacagttcaagtcttggtcatctttgcatcatagcacccaccactgtgcttggagcaaaagaaatgacaatacattttgaaatgaaagtgctaactggcagaatcccagccctgtgagactagatgaggttcatactcagggagggtcctctttttagatcaggcaggatttggggggtcctttggatcttttagataggggtatgagaccctcctctcaaaggagaaatatttaaaagtgttttaaaagtatagacatccctacaaatgggtgatgacgtttgagaaaaggaaagacccctagtactgtctcagagcatgctggcagtcatggcacagttcttagttcttgaaatgcggaccaacatctttgtcaccaagggagcctactcgggtcagttggctagtactcccagcacccattttgaatgaggcactgtgtccctaagagatgcagctctgaccaaggcagacacggtccctaccaccatggggcttagatactggagaggatgcagtcataaagtacattcctggtgaggtattaattcgactgtgataagcactgtgaccacaaagcagttctgggctgacctggtgagcttgtggtcgggggagcttagaggaagtgacgctggtgtcagtcacctgaagtgggggtagggattcaccagtcacagatggagggagagtccaggaaaggaagggcatctgcacaggccagagggaaaggcaggagttggaagaactaaagtccatgtggctggtgggcgggcagaagcgcaaagtgaatgtgagtgaaagcaagtgggtctgtcatcttggggtgaccaatgagtttgaggaacaagagtggataattgactcccatttgccctccccttcacctcagggtgcgtattacgagtctgaatattgtcctacttagaggttttctcatgatcttaagtctctattgtttacagctttcacttctctgccctcttccctctaggttattgggttcctgcaagttatctgggaactgatcaaagtttcagggtaagatggtggtgatgaacaccctgagggtcactcgtcctgtgtccccatgcaaattgctgtggagaagcttccagattccaaggcccaggccattctgcagcctctgtacttgtacttacaaaatccagaaataagcctgagagtacaccatttcattaaagagaggagaaaaggcttgttggttttataaaaatcacgcgtgttaagcgtttgtagctgtgatgtcatgggcattccagtgtgagattatatgccttatggactgtgagaataactgtttctctatttgtccagtaaaataaatgtggaacattctttcttgacaaatgttaaaatgttaaaatgatgtcatgcagaaactggagaaggtttcagatattctggaacctgttctttattatttctggttagcagttgtctttttactaaggttgatccacaaactgcagattatttctgtgaatcttaaattgctggaagctgcacatgaatgtttgcaagcagttcagtggcttcatgcttcagaatattctgtccagagttaagaattgcagaattaattctagctgactgatttgcaagtgtgtactctgctgtaaacacagaagatcatgtgacacagcaaatgttcttcctcaagcctttctcatctcgttcccctcctggaaatacaaggtactatctgcagctggatgttgcagggattctccactgtggcacgatggacattggggatggatcattctgtggcgtgggggctgccctttgctcactggatgttgagtggcatctctgatctcttgccagtagcactccccaaatgatcacattcagatacgtttcaagacattgctaaatgtcctctgggagggagggcaaaataaccctgggagagaaccgctgagatgataggagagatgtctgtgatggtggagagttgtgtttaatgaattggctaaatatatcttttgggtttttttaatatattttccactattcacaatgaatttacatagttttcaaatactggcttgtttcaggatttgaggtttctcagattgtgctcttcgggtttaccctttttgaacctccacgcacataagaaaaggaattccgttaataatgttgatttagctggatccattgccttgaaagtgcttcagaagaattttttattacaagtttattttgttttatcccaacattgactatgttctcattgaaatgagttggtcggggtcataacaaatttatgattgctgggtgtgcccatatcctacccagactggcttattccgaaccctgggactgcattctaaggcttaacgtggaaaaaatttagtcatatttatctagttactaacgttttgtgtgagtgtggggtttttgccttgatatttagtttgtctttatttgcagaaagttgaaagttaaatgcctaaagtccaatcagtctatgccattaggataacttgctgcttttagtgccaacagaaaccaaatagtggtcccccgaggagatggggttcacttgactaatagctatattatatgatgtgttcttgtttctaagttactagaaaaacacaggtggaagtcaacatttgattttgtttgtggtatgtttcactgttccaacctgttttccccaaggagaatattgtggtctttcttgccctgggcctttgagcaggtcctattcctatattctggaccctcatctgctcaattgtaaacacagttctcattgtttctgacagctcagtaccccagcagaaggctagtgtacgcttgtaaccaagaataaccccagattcttgagggttagaagctcagttatgaggccgggcacggtggctcatcccagcacttttgggagaccgaggaaggcggatcacctgaggtcaggagttcaagaccagcctgaccaacatagtgaaacctcgtctctactaaaaatacaaaaattagccaggcgtcgtggtgcatgcctgtagtctcagctactcaggaggctgaggcaggagaatcacttgaacctgggaggcggaggttgcagtgaaccaggatctgtactctgtctcaaacaaaaaaaaaaaaaaagaaagttgtggcagctacttctagtactttgttatcatcatcgtaggctcagtgcctgcctcagatgtttaagtctgaacattttaagaggaggcaaagcagaataaggagtgaatgaaagtaggaggttgtggcaaattcggtaagcagcatttcaggtcagcccagtgctctgtgctcatcatatctttgctcccaaggctctccacagataatctttagctgtcaactcagattgctgtttgctgttatctcaagtagcagacagtaactgttgatagtcctaactttagggacttgtaatataacaagataaaaataaaagcctacacctgttatccaagatgaaaataaaatcagtttcacttagcgtatcatctagtgaaatttagcgtgatgatcgcataaaaagatttaggtggccgggcatgatggctcacgcctgtaaccccagccctttgggaggccatgaggggcggatcacgaggtcaggagaacgagaccatcctggccaacatggtgaaaccccgtctctactaaaatacaaaaaattagccaggcatggtggcacacacctgtggtcccagttacacgggaggctgtgaggcaggggaatcgcttgaacccgggagtcggaggttgcagtgacccgagatcgtgccactgctctccaacctgggtgacagagcaggactctgtctccaaaaaaaaaaaagatttaggcatgagatcttaggccataggaaaattaatttaataatgttaattcttaatgaaatataaagagtatcagctataatgtaaatagtacaaatttaatattattccagtgattcttaatgttcatgatctccctgcttttagaaagaaaagaaacatttccttttaggataacttggactagaatggcgctgtctaaaatgtagccacaattaaatgtagccactgtgggtatttacctgtaaatttaagcacattaacattttatagcctcatgtgcctacaacttaccatactggacattttcatctttagagaaagttgtatttgacagcactgatttatattataactcaactgtgttataaagttctattatttttccaattaattttgaagaaccaaagcctggagaacaatacttgttttttggtttttgttttttttttaacttttattttaagttcaggggtatgtgtgcaggtttgttgtataggtaaacttgtcatgggggttttgtacagatgaggacaagagttttaacaggcttgttttgcaatgtcttcctaaagacctctgatataggctgggatgcctcagactgtactgtctccattaactttcaaataatcttgagaaacagtgggaggattaggagtcccatggaattgcactaatggcttcagggttgtcttcagctacctgggactgacgattagccctggaactgaccgccaagaaatgtgggcttttagtctcctgtgctgataactgcatgtgtattctatggctaatggactcagcatccaagtgccttttagagccctgatgctctaacaaggcaatttgtgatcctgcgattatcctcagccaagtcatacagagggtccctgtgtatacacccatcactgcactaaggccaaggcctacacagatggtcttcagtaacatgaggaaacagcacatccctcgtaaaaagggtggtacatagcaagggaccagataaaaagcacatgagggtatagggcaacattgtcctatagacatataattgagccacatatgtaattctcagttttctaatagtcacattagaaaaggggaaaagaaaacaggtgaaattaattttagtaacattttatttaacccagtatatccaggatattatcactttaacatgtgatccatataacagttattaccgagtttacattgtttaccttgcaccaagtcttcaaagcctgttgggtgttttacatttacagcaccactcatttaggattgaccacgggggcagcatggaaacaccagcgtttggaaagaatgaggagaatggttagataagtgaggagggttctactagaaaaacacaggcacttggacacagaagtttccacttgatgtactgtctttagcacaggagcaccctgacaaagccggtaatttgggaaaactgagtggctgaactcagggggtaaagggaagtgagaaaagaggacaaatgaccaagaggctttgtgtgaagtccatggcgtagagttcagaactaggctagtggtctgggcaaggcgaggaagagctaaacctgaacgattgttaaagaaaaataatgtgatcagtgggggtaatgggaaataaagcaaaaagaagcaaacttcttcggtgatatacttcatctgattcatttgatccaccgtagttgttgaaagccagcttgcttgcagagcagtgggggaggccgataactaagtgcgtgtgcatataattataactatacccatgtaataatgttgtgaaggacaaaaccagaatgctgtgattaaaaattcaaggggatcatgttataggagggtagtcaaagaggagaggaggtgacaattaaggcaataacaggagccagtgccaagtggaatgaggggaatgattccagcagaggagaagaatcaggaaccgaggggcttgaggcagaaatgagctttctacatttgaagagcccagggacatacaaggaggctagagaaataggtggtgcaagcataaaataaatcaaacgcaggactaggcatataaataagaattaagaccaagtgcatcctcaccatgaaatctaaaggagttttcttgctcatcagtgacagattattgacacctttttaatgacagtgtgcccttcactcatttaaactgtgattgaaatagtcacaatctcttcactttctacatataagaaaaacctgaaaatgaagcctctcagaatgcttcgtggtcaccttcctgttttgagggaaagtatgagaactgccaagaaatcatttctatctgtattttgttaaaatggtagaaggggagggaagaggaaaagaaaagtgtgaatttatcattagcaaaacaagcccttggcaaaaagttggcttcaatagggggataatgaccaaggaccacctctccccacagtgggttggatggtctagcctagatggtctttgtttaaaaaggaggaggtgggtaggaggaaagaaaccttctggaagctgaacttgtaaactcaagggcataaactgatcgtgtcattatggtcattaaagagcaattgaaggaacaggctcagttttcttgggctggtatttgcatgagtctgagtgttgatacttcccatttcatgaatgagatggggaacaattaaggatgaccaaggcatcgtcttagggagctgatcgtcactccagttcttccctagtcttcatggtagaccctgattgaatggctttgaagaatgtgaattctcacattatcaaccacagtctgagtgtctgaggggaaggtgcgtagtctctttgtgtcaggaatcttttaaaatataatcagggcctttcaagggctttctagaaggaatctgcattccaatcagatttatagtattgaaatattgtgccagttcaaatgcatttttaatttttggctcctaaatttaacagaaaattattgttctttttctgttgtattttttctgttttctgttgtaaatctattataaggaattctttcatactaagaaaaatgaaaacattgggttcaacctgttgggtattatgctcactggctggggtgataggactgttgggaccccaagcctcagtgtcactccatataccaaacctgcatgtgtaccctttatagttaaagttgaaattaattttttaaattaggtttaaatctctttagagataagagaatactatgttataggaagaaataggaaaaaaaaagaagaatattctgagtttctgcagactgagattctcacctgggccactattgacatttggggctggataacgctttgcactggtggcttcctcctgtgcttcgtagaatatttagcagcatccctggcatctatccactagatggcagtagcaccctcttccagttgtgacaatgaaaaatgtctctagatattaccaaatgtcctctggggccgtagtcactctccttgttgagaccactggtctggatgctcccaagagagctcagtgtctatactgccaggacacttttgcctaccaccacacaaaaataaagccaaggctaagattttaaacttccatctttgggctgctactgaagcaggagaactgtcgcccctgtaagagtaaaccagaagcaagtttctggtttttatggaaacaagaggatgtccctgccatattcgggggatttgactgggtgggagctgcctagttatttctcaaatccttcgacccattcttagtggtggggcaagatgcagagggtcattggtaatgatttctctcaattcatgtttctcctagttttcctattgtccttgattctacccatccatggtacttctaaaggacagggaaatggaccaccccaaactgatatacattggttctgctcatcacacatggggatctcaacaggccaatctgtgttaccagcaagtctactgatacttaccagggacttgctacagagacctggtgcttgactctggaagaaaatcagcatcagcaatgtcttcagtgcctatggaggatgaattgtatgtgtacaccttaatagataatctccacatccctgtgacacactgcaacctccagggaccttagcaatgccgatgttctacccaggttttgcaggatggctgcctggtcctcagagtttgcttacataggaggtgaactcaactcagcacgcacagttatgtggggcgagcatcttatgggatgcaggctacacaagtctttttttctaccagccaaccagttaaacactgacaatacttgattgaacatttcctttctcaaagttcttccatttctttcttttttttttaaatgagtctgttattgaaaatcgaattagtttgtctttgtatttagagctagtttgggggcttggggcttgggaaattctcaaagaagaaaagaaactcatttatgaatacctatttccacatggcgctaatctccatgcattttactgttatcacaggactgattgcacttggtttaggtgagcttagtaggcagactgagacgagttgggttttcaagatggcagaatgctgtttttctgcacagtgctttctgacttgtctttagcctttgctttagtcagctgcttaaggccctgaatggctaattgctaaagctcttagttcccattagccttgacagggtctccagaagtggaattgcctcatgtgtgatgctagatagtagacagtcttgataatagcctgacctgctttctcctagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcaggtgagggcaagatctggtggtcttgtaaggagttaaagaaacagtgtcatgttaacagaggacacatcaaactctctccatgatagtattgacctctttgtgagcaatggcatggaactcattggaatttaaaaaaaaattgtggtgaaatacacataatatgaaatttatcatcttaaccatttttaagaatacagtcaagtagtattatattaagtacatttccattagtgtacaatcatcaccaccatctatctccagaaatcctttcatcttgcaaaactgaaactttacccattaaacagtagcaccccattcaccctccctccagcttctcgcagtcagtatttggcttgcttgcttgcttgcttttcttttcttttttttggaaacagattcttgctctgtcacccaggctggagtacagtggggcagtcttggctcactgcaacctctgcctcccaggttcaagcaattctcctgcctcagcctcccgagtacctgggattacaggtgcccgtcaccacgcccagctaacttttgtatttttagtagagagggggttttaccatgttggccaggctggtctcgaactcctgacctcaagtgatctgcccgccttggtctcccaaagtgctgggattacaggcatgagccaccatacccagccagtattctgctttctgtctctgtgaatcggactactctaggcacctcatatgagtggaatcatacagtatttgtctttttgtgactggcttatttcagttggtataatgtcctcagagttcatcgatgttgtagtatgtgtcagaatttccttcccttttaaggcttaatgatactccattatatggatagaccacatttgtttatctattccttaccttttggcttttgtgagtaatgctgctatgaacatgggtgtacaaatatctctttttgactcagttttccgttcttttgggtatatgccctgaatgggctttctggatgatcactggactcacttttcagtgtatggaaaaattcccttctcttttatatggatgtttccttctactagtataggtaatattttctattaacaaatacatatatctgtatgtacagattttgtaattgatatagaagaaagggcatgaaatgaaatgaaagatttgccagaaatctattttctgtgtgtgtatgtgttgaatatgtactagttttccttggctggcttactttgcagataacttctatattaaatagtaattatgtttaattacattttaaaatgtaagattgcaatacagagcagaaggataattaggcaagaaaaacacattttatatttggggtcacctgataacgtgtatgtattttatcatttatatatttatgtttgtaacattttctgagtggcaactatgtgcaaggcactgcacaaagtaccaggagtactaattctcaaccacccaaagggcaaagtctagtgagggaagaatactcgaaattaaaattataaagcaagtgtgatttgaaaaatgtttctgaaagtgctatgggaccacagaggaaggcatgtgatacagaccactcagaggagtctatgatgatttcactaaggaggagccatttatattaggtattaaaggatgtatggaagtttgccaagaggattagaagggcattctagactgagggaaaatcgtgcaaaggcagatttgatagaatgttcaggaaatgaccaaaaaacaaaatgatgtgaccagaatgttgaatgtgtgttgtggggagaggcagtgagagtggtgatcatcaaagcataatagggtagatggagggcaggctcatcagaaactagttatttgtaaacaagagagtggcatagcttgatttcgtttaattagcagtttatgtttttagattaacccaggcaacaatgcagggccacaagttgcgattaatccaagtgatagatggtgagagattaaatgaaggcaatagaaatatagaaaatgagcaacttttaaaaagcatttctgaaataaaagcaacaggactaggaggtgagatcctcttccagagaacagaaagcaaagttaaccaagaccttgaggtgtctcacttaggagacttgggggaatggtgatgccagaaaataagttcatgagtggtggacaaggaatgatttgtagagaagttatcttaatccatttgtgttgctgcaaaggaatatctgaaactgtgtaatttataaagaaaagaggtttacttggctcatggtgctacaggctgtacaagaaacatggtgctcacatctgcatctggtgagggcctcaaactgtttcccctcatgttggaaggccaaggggagccaacgtgcagagatcacatggtaagagggagaggaggaggtaccaggctcttttcaacaatcagttctgtggctgaatgtgatggctcacacctgtaatcccagcactttgggaggccaatgcgggaggatggcttgaggtcaggaattggagaccagcctgggcaatatagtgagaccttgtctatacaaaaaaaaattttaattaaaaaaaaaaacaattggccaggtatggtggcccatgcctgtagtcccagctacttgggaggctgaggtgggagtgtcacttgagcctagcaggtcaaggctgcagtgagtcacagttgtgccaccgtactccagcctgcgtgacagagtgagaccctgtctcaaaaaaaaaaaaacccaaatcagttctcttgggaactaagagtaagaactcacttccacccgaatggcaccaagctatttataagggatctgcccgcgtgatccaaacacctcccatgaagccccacctccaacattggggagcaggtgtcaacatgagacctggcaggaccaaacagaccatatccaaaccatagcaaaagtatagggaaatcataaggaaatataattgcttcttacagcttttttgtaatttaggttttgtttgtttggtttattggttttgtttttttttttaataggctctcactgtgtcacccacgctggtgtgcagtggtgcagtcatagctcactgcagccttgaacttctgagcccaagtgatccttccgcctcagcttcccaagtagcagggactacacgattatgtaccaccacgccaaactcatttttaaattttttgtagagatgagatctcactgtgttgccgaggctgggcttgaactcctggcttcaggtgatgctcttgccccagcctcccaaagtgctgatgtgagccatcgcacctggcagcaatttagttttaaatgttgtatcaacaataaaaagaacattttaaatggtcatctctcaaagaagaaatgtgtcttcaactcttttttttcttttttttttttctttgagacggagtctttctctgtcacctaagtggcgtacggtggcgcgatcttggctcacttcaacctccgcctcccgggttcaagcgatccttccacctcagcctcctgagaagctggggttacaggcatccaccaccacacctgctaatttttgtatttttttttagtagagacggggtttcaccatgttggccgggctgatctcaatctcttgacctcaaatgatccacccaccttggcctcccaaagtcttggcattacagatgtgagccaccacacccggccagtcttcaactcttgtctaattcctataaggagaacttacttttctcaatataaacattttctctcctttaaatgtaaatggattttggatgttagtatttcatgcaaagcagaatgggaacgagcaaatgttgatcccttactgaaatgcgactcagtttgctatatgtattttattttatttttctccccgagtccttttattccaaagaaatattaattgctgtccttgcctaaatttcttcctgatctttgtttctatctcattttggattgtcatatggttttcttggtggctttactttgggtgaggaaacatgtttaaatgtcataggttgactgaggctgtgggtttattctggagagattctgtatagtcacgtgttaaccctcttttcatggtgtttcagctgcacttagtgcattggaacgcagtcaaatttgaaaactttgaggatgcagcactggaagaaaatggtttggctgtgataggagtatttttaaaggtaaaaaatctcaccaactttaaatgacgtgttgtattctaggatgaaaagatagaacagtataatattgttatttactttaagaatattgggatccctacactggtaagataaatagtgattgttaaggatatattttaaatggcatgaaaccgtgccatccaatagagtggtcacaagccacacgtgacagttgggcacttgaaatgtggctggtgtaacttaggaaatgaagatttaatttacttctaattcacttaaatttcaattaaaaaactgatattcaattcagttattgaaaaacttttgggttgggcgtggtggctcacgcctgtaatcccagccctttgggaggccgaggcaggcagatcacttaaggccaggagttcgaagccagcctggccaacatggcgaaaccctgtctctactaaaaatacaaaaattggccgggcgtgaaggcaggcgcctgtaatcccagcttcttgggaagctgaggcacaagaattgcttgagcccacgaggcagaggttgtagtaagccaggatcgtgccactgcactccagcctgggcgacagaacgagactgtctcaaaaaaaaaaaaaaaaaaaaaagaaaaacttttaagaatgtttggaaccatttggatatgtatatatatgttttcaagtataaattttttgaaatctaaatatagatcaagtatttttgatgaaaaaggtagcatccaaattgagatgtgctgaagtgtaaaatacacaacagatttttaaaacttagtatggaaaaaatataaaccatctcattaataacttttcgtattgattacattttgaagtgataatatattgaatatatttggtaaaataaaatattaaaaaggatttcatctatttttactttttaaatgtggtcactagaaaattaattacctctgtggcttgtatcatacttctgtttttaagcattggtataaaaggataaaggcgaataaataaataatagttaaaatgtaagattaatgtattttaggccaggtgcgatggctcacacctgttgtcccagcactttggggaggccgaggcgggcggattacttgagtccacgagttcgagaccagcctggccaacatggtgaaaccccgtctctactgaaaatataaaaattagctgggtgtggtggcgggcacctgtagccccagctactcgggaggctgaggcaagaggatcacttgaacccgggaggcaggagctgcagtgagctgagatcgcgccactgcactccagcctgggtgacagagtgagactctgtctcaaaaaatttaaaaaaaaagaatacattttaaacggaagaatgtattttaagcagaatagaaagataaaggcaaataactaggaaatcttgaagggaactaatattcatgagtgctaagtgactccatatttgccaagtgcttagtttatctttctaagaattcggcaatattattgtctccatttttcagatgaagaaagtgaagctcagcgaggttaagtgctttcttgctaggtcacacagctagctaacggaggactggggttaaaaatccataggccacactctcatggggcccctgagctcttgcaggttcagcagctacaggcttcctgcatgcttccaactttagtctgcactagaggctgagcgttttaagggtacctgggatttgttttagtcgggtacagtaagacatgcagacatgggaatgactgtcatgaaggaagaagttgatcctgtttccagatccctagaagctggaggcatggcacactgtgcagagccacatgaggaagcaccagggttggtcaagaggcagagaatgtgaggggaaaatgcgggcaagagcttttattgtggtttcagtgggaaggaacaggcgaggcagggtaagcaggcttgggattggctagtttgaataatttcagagtgttctggggcctagggggctgtccccacttggctgatacctgaccgtggagtgattggtgcaggagaacagtggccccagtctaagagcctgataaaggagatggtggggctgtaagctctggattgcatatgaaaggtgctcttgcagttgtctgttctctctgggaattagccagccttgggagggacagtgcttgtggtgtcaacaagtccccagatatcaaagcattaaatacaaaagctattaatagaaaacgtgctttatgtactgagtctcctggaacatgcccttgaggacttaggggcctgcgccgaaagcctggccttcatgtgctgtaacctgtttgaagagcttcagcctccagggtccctgtgggccaaggcttaggaaggcccggggaggtgagtggagcaggagcacctttccctgtggactgcaggcacaacgtcagacagcctgctcatgtgttctgtgtccagtttagttcggtgatgtttataacattctaaattgccagtttaagtggtttcagactgtgatttgcttttaggtaatcaccagatggtcatttttaattcatatttcattccaattctacagtgagatgtccgttgtttttaatgttttctcatttgttgttctttagctaggcaaacatcataaagagctatagaaattggtggattccatgccatcaactaagtgtggggtagtatttttcctaaattgcctgaaatatattttgtgtttcaatctcaagagtggagacattaccaaggcactttgaattgggaagtttaagtaggtgaactgtattccagttctctttcaacactgccttagaaggagacctgtaatttatgaatgaccctggccctgggtcacattgcaggggacagaagtgatcatgtgggtgggccagtgagctttctggttttgctgcagtgccgctgaggacttggggactcaggaacatattgctgtcccctcctctgttcctgacaccggctccttctaagtccttgtgaacacacccagagcagccttctgttctgtagctgccatcccacaggcagggagcagagcgcagttctacagaaacttgccttgtccagctggaaagaacaatgacccacatccttcaggttggatgcctttgtccagccccccaagattatttcttctatattcagaatctcaaagggctgtgctctggaggcccatatattgtctccttctccctttcatcccccactgtatccttctggtccccacctctttccccctgctttcctctccatttccctcttttttcctctctccccttttagtccaggtttctggctcctcctgatctgcatttcattttttgtttgtttctatcaacttttattttagatacagggggtaccatgtgcaagtttgttacataagtatgttgcatgatggtgaggtttggggtacagattccatcactcaggtaatgagcacagtaccaaatgggtagttttttaaccctctcccccctccagtaacccccagtgtctattgttcccatctttatatctgtgtgctcaatgtttagttctctcaagaacatgcagcatttggttttctgttcctgcattaattcgcttaggatgatggcttccagctgcatccatgttgctgcaaaggacattatttcattttttatggctgtgtagtattccatagtgtatatattacattttctttatccagtccgccgctgatgggcacctaggttgattctgtgtctttgctattgtgaatagtgtgacagtgaacatatgagtgcatgtgtctttttggcaaaatgatttattttcctttgggtttatatccagtaatggtattgctgcattaaatggtagctctgtttttagttatttgagaaatctacaaactactttccatagtggctgaactaatttacattcccaccaacagtgtatatgcattccctttttgccacagcctcaccaacatctgttgttttttgactttttaataatagccattctgactgttttaagatggtatctcgttgcggttttgatttgtacttttctgatgattactgatgatgagcatttttcatgtttgttggctacttgtatgtcctgagaaatgtctgttcatgtcctttgtcccttttttaatggggttgtttttctgcattgcattttaaaaggaaaattctcagtctcccttgaagaagtgaagcctccttctttatgcactggccactgtctaatacctcccagcaatactcagaggagactacctgctggaacctcactagaattgagagatcaaatggttttggctgttttcccactggagaatataaaaaatacacagttaattttagaaacaaaggctgggcatgattccatcctaagcagcaattcttcaggtagctgcccagaagggcctggagctcctctggaccactgctgatctccagatactccctgagaaccgtcacctcggcgtccaattcctgagtggttttcactactaaataatgactcagtgacccagtctcttggccaggacgctgttatggaatttgggtcgtttggcacttcctgcctggtgcccacctgtctagattactggacccaagtaggtccagtatctccctggtccagccctgtcttgagtccatcacctttatcattaagaagcagccagtagaggttgatgatgatcaggtacgttctctccacaattttcatctaaggaaatcctcgtctccccttttaaaacaaggctgggctcagactgtggcatcagttttaacatcttgtaatgcttatacatttttattgaagtgtaccaacgtcttatctcagtttggacatgaatttagagatatttcaaattagctagagagaagagttaaaacatagaagaacataagctttttacatctatatttgacagtgacatatgtttttattatacatgcattgtgtagattctctatgaaaattaagacccttttaaataaaaaaacgaaggctggaaatgggtgtattcaaaaccctttaaaatccttaagggagttttgctatagaatctcaggataaagacagactccgacaatattcatccagaaattttcatgtaagtcagttgtttgaaacttgggatttatttttctcttagaaactaagtctaagtggtggttactacatcagcacacaaaatcctgtttaattcataaactaaactgtaataataactgcgtttacttgttcatattggatttttattgactaaaagcttccagcctctttttcatgcagccaggataacagtgataccaaaacctatcaaagattagaccatcctacccccaaaatataacaataggccaatatctctaaaaaatatgtaacaacagaaaaaaaagctaaataaaatagtagaaatagaatctagcagtgcattagaagaaatatatactttgtccaggtagggtttattccagtaatccacagatggttcagtactaagaatgatatacttacaattaatggatttcatcccatcaacaaatctatatgatcatttccatggatttcctaaaatacgttagacaaaacccaccatccctttaaaaatttttttaataaaacagaaatgaagaattccctaactggatgaagtagatttatctcagctcaaaaataaatagtatgtttaatgtggaaaggatatcattaactccatggttattagcatactaaatattaaatttaattgaattaacctctggcaggagccaataaagttaggccaaaaaacataaagaacattagagaaacactaaaaactcctacaaagataattcagcaattagtggagtaccatgtcaatttatagaaatcaattccgttggcatatataactcacagttagttaaaagacataacagaagaaggaaacctacttataatagaaactaaaataatgttaataaacaacataaaatgttaagaaagctataaaacatttctgagggacacagaagacttgactttataaaattcataccctgtttttacataggaagatattataaagacacctttgatgtcagttctccttaagttgattccataaatttaatatggttttaataaaaataccaacagaattttaaaactagatatagtacttctagagttcatgtggaaaagcagataagcatgaatagctggaaaaattctaaaggaggaaaataaggaatgattagacccataaggctttaaagccacaataattaaatagtatgatactagcacatgaataggaagataaatcaaggaagaaaatagttcagaaatatgtccaaatacatgagaatttactttatggtaaagataggatctcagctcaatgcaggaaaagataaatccagtaaatggcattgggggacaactgagcaggcatttaggagaaaaagttggacccatcgttcaatcctgacaaaaatatattctggatggaacaaaactttaaaggtaaaaaaatgccatagaagtacgaggataagcataggaaaattctttcatacatccaagtggaggaagcttttctaactataaatcaaaacccagaagtaatcaagaaaacaactagcaattagactacatacaaaaattttaaaatcctttctgatgaaaatcaccgtaaacaaaagataaatgacaaacagggaaaacatttgcaactctgttccctcattcagctactatttattcaatgcctactatatgccagctactcttctaggtgtttgagacatcatagtgaacaaaacagagagttaattgccctaatatacaaagagtttctagaaatcagtttttagataatcaacagcaaatggtataaacagacagcttacagttaaggaaacaagaaacccaataccatgtgaaaaaattttcagccttgcttataaaaagtgacgaaacaagatgaaactacactgaaatacaaattttcacatatcagattagcagaaaccccaaaattgtattgctcacagtgctggtacaagtgtggagcatgggcagcctcatgtgttactggtaggtggtaatgacacatgaataaagatataataggctaaaaa

SEQ ID NO: 825 - DNA, 123692 bp, Homo sapiens
gactcacacatgatctaaagaagccacttattccataatattttaaataaataccccccataccacagattaaaggatgattaagagatgcttcatgtcctcagaatgcatgtttattaggaaaaacagcataacaggctttaaggcaggctttggggaagcagaaagatgtggaaaaaaaaaaaaaaaaaaaaagagatgagaggccaccaaagagaacatgttcatttttacagtctgagaggccctacagccagagcagttcaagattgctagaccttagaagaagcctcagagatcactgacggcctcctgtttcactcaaaaggatacagaggaccagagagtttaatggatttcctcccaaatatgtagacagcactgttacctgctcacctacaaaattgcaggtgcatttcctttatttcttcacttcagatatcttttttaaaatttcagcttttaaatatggaggtacatgtgcagatttattacatggaaatattgcatgatgctgagatttggaatacagatcgggatttctatgtcctgtataggaaaatgtgcaatgccgatatggtactatacattttctatgtccatatattttccatacccttgcatcttccatgacaactatgtgtttaggactttgggatttttacagacaggtacaattataaacacaaaaccgctgattgctgagtatacttgccaacctatcattttgctgagtaattttattttaaaaaaggcaaaaaaaagaaaattccatctaccgtgaacatcattttataagagacataaccagagaaaaggacgttcatttaaatggtagaaatgtgaaccagtgttggggaccccactgactctctctacactgccccagtttatcagccagctgctacacaaatgggttcacatgaatactaagacctaggtatactggttttacctacatgggctcatcttaatatccagtaggaaattacattgaccgtccatgtctgtttccaaccaacgtctttgtttgggttctcaaaagcagacacacagccaaagctttgaatactaatagtgtatttgggagacgagtggtggaataaggcagggaagggaaagaagcaactacagtgtgtactgtgagcaactggctcaacatggaactgctggggacctctaggcaatacctcagatatttaatgatcacctccacatccatcattggtgaagcactgctcccaggagcatctaactccctagcactattggcctgctcctgtaaccacagaaagtcttcaggcaaagagacacaactgtttgtgtgagtctcctgtcacagagagtgctggggggacatgatgtggcaccaacaacattaatattgagactatttcttttttaatgctactattgggtggataatttgtatgttttaacaaataagaccattttttttattccctgagttttcaaaaggcattctagacactttgtgatctcttttttagtaagaacttgacacatccaggagaaaataagagtgagaactaaggaggtctctagagcacagacggtgatgggactgacttatgttggcttttgcctacttaggcagttagataatagaaaaaaaaacacttaggacataagagatttagggactgtcagatgagtgtgtcaaaaaaagttgaatttatttccccttcctaataagctaaaattagtcactactgaataaatcaaaaaggctactggcaccttatttcagaaacttgccaaattctgatgcataagactttgttgtttgtgctttatgttaactctggattcctatctggttataacaaagctttagcatgatgtcttttcatatctataaccatacagagagccatattaagacataaggaaaaacagggttaagatttattggaccaggccctgtgagaagatttagatattcctttatttgctgaaaatctatcattcctggcactgtgtataggctcaagattcaaagatcaggaagatgttttcctgccctcaaggagctcacagtgtaatagacacaaaatctgaatacaaactgaatacaaagtggaaaattaggaattggagtacccactgttgccaaatcaagccaagggtttggaaactggaaatccagctgaggagtaggaaaagacaagtctcagtgtccaaaaacaaaaaacaaaaaacaaaaaaaaacaaacaaaaaaagagcttatgtatagttagaccacagcaaaatcaattgaagtataggaatgaccctaaaacttggacagaaattaagcccttgctttccccggtcatccttaatatttttctcttggaaaccactttccctaccaggtccaaatagacttcaactgtgacaaagacatcagtctcaacatttggacctgaagttagtcctgttgtagactccatagcaggcatgcatgaggtgagccctgggtaccccatatcttgccttcacacttgctgtttatattgtaggattgagtttttgccttagtatcatattggcattgcacatttccctaaatctcagcccacatgaccagcactttaactatttccagacatatgagtacatccttcttaccaaggcagatagatcctcttgccatgtgtctcaccgtctatctcccacaatctcttgcaagcttcctggatcctgttctgattaatcatcttgtcccatacttggatgactctgagtaccaaacattgtctgtgtccctgttcctgtgcccccatctaacagtcagggtccctcccacagggcccctgctttctgcttccttccagaagtctatgtactcctgaaatccccaaaaaaactcacagaagagctccactcatatatgatattgggcttagtttccagataatgtcttcccaactagattggaagtgctgtcaggaaattaaaatataagggcctactaatacatgagaaattaatgcatttaagtatagtaagggaaaagcacatagctgctgcagttgcatctcaataaagagctaaatctctagaagaagaaagtcgaaacatagtctcataaacttgactgcaggctgtcacccacatatttgaaataataaccagaggtgctgagttttcaattttctgataatataatattagtaattttaacccaacatccaatattgaccctggaaatgttttgaatttaagccacaacatatgtacaggcagcataactcattggcaagaacaagtgccaaggtcacaattcatgctggaatcatttctgccacttcctccccttcaaccaccttctagttgaagtgatggagatttggtagcatctaggaagttttggcagctgatgacaagttattactttgacaataacaccatgttattattttgaaattttagctactgagccacaacactatacacccaagacagtcctctatggaccagctgggtgcatggctttgaggcctgatggtaaggccttggcaggatttgctgttcttggaattacccactgctatacaacctcctccatctcagttgacccatcttagtttcccatctctatatttcactaacaaatcagatttagcaccattgttcattaaaaagaatgatgtataaatggaaactccatctaacagttgagtgaagagcttgtgtacttcccaggacagtgaacaaaatcatcagacaagaattaatttgaggcttctcttccactgatatttgcaatattcttaaattggaaccattatttctactggaaaaaaaaacaggtagtatatgtttactaaaatcttattattggtacttaaagctctaaatacaactgattcttgaaaagataatttatataattactactgattattcattccggggtgatgatatcctagtatatgcaacaactctgtatgatcatattctgctaatacttccatgttccacatgtcttctagtcctcggtaggcgtatctaagaaaatgaaagtaactcatcctttccaggacactaggggaaaacagcaacacacaaagtaagccatcattagatttggggcctgagaaagcatttgagcatgagagaaagatgacttcgctttttggtagatacataccaccccttgctacatacatatgcacgcacatccactcacatcccccatcacacacacacacacacacacacacacacacatgctctacgaacagctgtctgagcagattttagggcataatcctaccttcccacagaagtgtagtgtgttagtctgttctcacgctgctaataaagacatacacaaaactgggtaatttataaaggaaagaggtttaatggactcacagttccacatggctggggaggcctcaccatcacggcagaaggcaaatgaggagcaaaggcttgtcttacatggcagcaggcaagaaacggtgtgcaggggaacttccatttataaaaaccatcatatctcatgagacttattcactaccatgagagcaggatggaaaagacccacccccatgattcagttacctcccaccaggtccctcccatgacacgtgggaattatgggagctacaattcaagatgagatttgggtggggacagagccaaaccatatcgggcagcaagaacaaagctattttttctccttacctagctgcactgacaacactcagtgagattattgggtagagcctcaacctcattcttacagatgcttcaatttataatttagtaatacaaacaagatatcttgctattgtacttcccttttcactactaattgcccttaacaccaagcacgttacagtcattaaatgcagtgctaacatcacccttccactcttgaaattgttaacagcaacagtgaacacaatatataacattttaattttttaaattatttttaaaaatatacttccacatctttttcccctcactgcattattgacacatgatacatgtaaacacacacatagatattcacccattcccacccccttgaaaacacacacaaacagcacatacacacacaagctcacctacattcctacctaccttcctctccttcccccccaccacacacacagacttagaggcaggggcaagaattgttagaaaagccacaatttatctgacagaatctgacctttctaagatttggattcccaggagcaacagaaacaaaatgtaatgtaatagttagtaaaacagtgtttaggtttgaggaaatgttactgtgccaatgagaaagatatgtgcatatatcttagtttggggtcccctagaggcagaacctgagacaaggaattgccagctgagcgggtagtttatttgggaaggaaatgcaaatgacaggggaagggaagacaggcaataaagagtacacgagtgatgagcaggtttacctggtaagaaattggagcttgagccctctgagaaaatctgagcacatctcaaaattatcacttctaacccaaaggcgaaggaggtcgggatttgtacccccaactctctttagtaattggttgagggatggggtgggaaatgggtaattccgtggcactgtttatgacttgctgcaggtaggcaaataagaccctggaggccagagagaagcctcagaacaatacatttaggtacaggcaagttggatgaaaatggtgaaggacacaagcgacgtgctacagcatacatttgcttccgtgtatgttttagtatgtactagcacgtatgttttcatatagctatgtgagcaaaattgcttctataaatgtggcacaagacactgtgccacacttatagacacatagacaaaacattaggccacagacaaaaaggtaggccaacagcgaaatgaaaaagatcctccaaacggcaagggaaaaacctactgaaaagaaaaacagaacgactcaactgtagatcatggacatcagatggtggcttagaaatgccacaatgataaaatgcttctgcagtagacagaaataacattagctcctcccaaccatgaaaattatgaagaaagccacatgccagaatcaccacaaaatgacagttatctggattttaaatagcttacattcttccaaattaatctacaaaaaaaggcaagataaaacaatatcagaacaactggggattcccagcaatttcatgaaaagacatgaacttgcaaagactagaatagaaagtttgcaccagataatgttcagataaacaagatagttccctgactgctctaaaaataggcatgtagctcaacaagatagagaccagccaactagacaaagaacaaagagcttgtggtaaactgcaaaaatagccacgaatcttcctttccccatcaccaaaccctcatgatcaatgtgcctttgtaactccacccatcagtgagtgggccccacccagtttccaccactagaatctgggttggttctcctgacttggctaaaggaatagaagtttacttaacacaagcagaatcctgcaggctgatgaacaatgcagaacccaggttccttcctgatacggtttggctgtgtccccacccaaatctcatcttgaattcccacgtgttgtgggagggacctggtgggaggtaactgaatcatcggggcaggtctttcctgtgctgttctcgtgacagtgaataagtctcatgagatctgatggttttgaaaaatgggagtctccctgtacaagctctctctttgcctgctgccactcatgtaagacatgacttgctcctccttgccttccaccatgattgtgaggcttccccagccacatgaaactaataaaagtccaacctctttcttaagaaacttttaagaaacttaactttcttaagaaagttaaatgtctttcttttgtaaatcgcccagtcttgggtatgtctttatcagcagcatgaaaatggactaatatacttcccctttgtccccacctcaccaaactgctcgcaaactaccagacaaggaagacatatgcctaaggcccaagaaaggtgctgagtgagacccagaccagatgaatttcctggaagatggtggtagttttaggttactaatctttggagtaggtttgtcatgcagcaactgcttactttctcaagaccctgataggccttcaggctcaacatgcatttcatgctttacaaatatttattaattgcttactgtggcctgccactgttctaggttcagggtataaataaatgataaaaagagtcaaagtatctactctcatggagtttgcattcagatatgaagaaacatctaagcaaataataaaataaatatataatatgctagacggtgataagtcttgagaaagaaagaaaaatggggtaagggtgtcagcaagtgacagaggttgagggcactgtttcagacagcagttgggaaggcctctctgtggacctgacatttgcactggcttctagctacctgtcctctccatctcccacctctcttcctgtagttcacttcactccagtcacactggccttctcttctaaccagcaatgcatattgttgccttggagcatttatactccctgttggctccacttcattcatggaggtatctgcaagaagagcctctgagtggagggaacagtgagtgggggttgctcttacctgatatgggagaaactggaggaggagtgatgctcaaaatagtttccactgttctccagagtctaagctaaaattatctggcaagggtgtaggggttggggtgattccatggagagccttaactctaaaagaaaggtggagcagcatcttcctcgtcagacagggaatgaagatgccacaaaatgatcacctttcctaatctgaatatataggtgctttcagtatacccaaattcttacagtaaaagaatcttgagctagaactggatattcttgatcaaaggaatccaataagcaatatacactactgatttagttatttaaacacttgattgtcatggttttccctctgcaaagctcccaatgccattgtttattaccttcagctgttacagaatttgggaaaggggatgaggttctctacatgtctgatcccagagctagtgatattattccatttttccagatgagaaaaccctcagaaagtttacaaagtaaattccatacacgagatttcaagtcaagtttgtctcattccaattataccatgaacactaaattcccttctctgtatcccccaatcagtctttctttggctgaataattcaaaataagcccaactcaagtgtaaattagtacagccactatggagaacagtttggaggtttcttgaaaaactaaaaatagagctaccatacaacacaacaatcccactcctagatatataccccccaaaaaaggaaatcagtatatcaaagagatatctggattctcgtgtttattgcagcactactcacaatagctaagatctggaagcaatctaagtatccatcaacagatgaatggataaagaaaatgtggtatgtatacacaatggagtactattcaggcataaaaaagaatgagatcctgtcatttgtaaaaacatggatggaattggaggccattatattaagtgaaataagacaggcacagaaagacaaactttgcatgttctcatttatttgtgggagctaaaaattaaaacaattgaattcatggacatagagagtagaaagatggttaccagaggctgggaaggacagtgtggggctggggtggggtaatggttaatggatacaaaaaaaaaaatggttagaatgcatgaataagatctaatatttgctaacacaacagggggactatagtaaaaaataatttaattgtccattttaaagtaactaaaataatatatttggattatttgtaacacaaaggataaatgcttgaggtgatggataccccatttaccctgatatgattattaaacattacatgcctatatcaaaatatcttatgtgccacataaaaatatatgcctactacgtacccacaaaaataaaaaaaaaataaaaagacaaaaaaaatactcccacctccacttcttttacaattggagaacaactctgatgtctccattacattttcttttcttttatagcctgaatgtcaccagttcctgtaatgctttctcaacgatatgatgcccctatctttaaatctcactcaataatgtttttcttacagtgaagggactggtcttacacacatagcttgaatgataatgactgtaaaacttcccttgatctggacaactaggtttgttttcatttttggaatctgaaacagaaataatttcctctcccacatcacagtcattgactcattacatctacagtaaaataaaacctccaggtctttcatcctaaactatatttgccgttctccctctcagtctcatgcaatttgttttttatctaattgtgtcttggtttgggtttcctgagaagcagattatttgacaaagctgcaagtatgagtggttcctgtaggaggtgatccaaggaaacctctgtaatggaatgaggaattgaggcagtgaaggacaagcatacaataaagcattaccaaccaagtttccactgtgggcaaataaagtccaattcctttacagaattctaggagactgtgcagaacatacctcagagttatgccagctgagcagtgagaaactggatgatttgtccactaacaacccatcatgtaataaacatatccttatacttccacccttgcccctgaccaaaagggccaccaggacaagcaaacaatactgaattatctcatccagcccatgttggttgcctgtgtttaaatgttatgaagtaaatacaaggtagctattaattaagcaggcccccaaaccccttactatgtggagagttttagtaccccaaaatgacaaaactgttgttttttaaaatgccttttttttccaaaataatttatagcttagaattatgcaggctattactatgcttccttccaataaagtggaattagtactcatttgctataatttactatctaatcccattcaccaggaaaatgtcctcaagttcaggaaaacacttctcttggggcctgcttctttcttgcaggaaaatttcagcagaaaaatctgtactgtctcatttccagagcacttttggttttacagatacttaccagtgatactttaggatctgagttacttctcagtgaataaatgcagaggaacaataaggtttattgtgccaaattttgtttgcattagggtttttttaaaaagacttctaatgtcttcctatttcttatgctggatgattttctgacacacaacagacacactggaaaaggagacataaacagaatcgatgtctttcattcaacaagaaaagaacgctcccttcttaaggaaagacaaggctggatattggcctaattttcatcaggatatgtattccaattaatgaaactccaccaagagagatcattgctgagataagcctaggaggaaaaagctctgctctcccttttgttagatgctcttctcatttccattgacatatttcactgttatacagaccagaatattagaccgatctcatcatgtaatgttcttttagtttttcttttttcaatgaactgtgggtctcaatgaaaagctttgaaaatagtaaatgctcatgagagatttttgtggcttgacttttcactgtcacgtacaaacttattccaagagcaacacatttcctgattcctttcaaatattttggtcattaactttttattatctcctttgcaacaaggttacaattattgggctgttacagcactaaatagaatcgttcaatgaatagtaggtaaattttcatgttcaaaatattgatggttccttcatgcctcataatatccagagaacaacacagaagggtagttggaagaaggcttatcaagttaatctaatacaacccttcaacagctggacttttatcaaactattcagttagatacttttctttaggacagggatggcaaatgcacggtattagcatgctgcctcccctcaccagcatatgagagactgatcaatcagagtcctcataattaatctttttcaactcaaccctgaaggcagccaagactaattgatcaaagtaggcactgagatgatatcagcagatccctaaccaactttggcagtgtgatgcactatcttgataagctttccatcagcaaacttatacccaattctaagccacatgtgctcaattcataagtcaaagtaataggcacatatggccctcaactgttttatccagttgaaaacctgtgagccaagattcgcaaaagtcacgggcaatgtactcagcttcatggatggctcatcaaccacaaaatgtagaaagtagctacagtcccactttttctatggggaaggttactcttgaacaaagagcatgacttgcctctagcacaagcgtaagcacacagtcaacataaataatgatttttagtgaataagtcattgaaatgaacaattcaccttgaaattcatggggcaaagcacgctacccctccataaaacaaataaatgagatttaacctgtcctagagtatggctaaaaatgacaatatctctttgattttagctgtgtccctccataaagaaaggaaacctaatttggtcccctgttccttgaatgatacgcacttgtatttccaacatggattcacatcatctcataatccttagcagtcttgacctggagacttcaagcagcctgtcaggatgtttttaaaggaaatctctgctcgcttagcacgtttcagagatcctctctgccttaattctcaccgctacctatcagctaatattgttaagaggcaggcacatatgcaaagaaaattatattcttctggacaccttattccccttatttctatctaaaagattttctttgcaataccatgtcatcaaaccaaaagtgtttattgcctctaatctgtatatcattctgtactttccatttttctcccatgggcatgattttaaccagtaattcctaatcttttcaggcagtcctaacagcccagccaaccaattgatggtgtgtaaccttttgtttttcatttcaggagagacacttcccattgcaggccaaacttacaattattacactggcctgtatgttgctactttccttggaaattgcattttccatttctgacatcatttgttctcttaacaattccagtgagaatcttctcatgtggttctgaagaaatgggcccaagctttagcggaacacagcaacgcaatatgaatataaatttactaacatctaaggaatttgaggcttttgttcttcacccaactttgcctgcaaccacagacatcacgaggtagtgttatagtggaggatcaatattgaacacactctacataatttatatactgctttgtagggggcaactattacttgttttaatcattcaggacattagaatcttaactgcaattgccattggtgccagaacaaggcatggggctactcttccttgagcttacactgtaattacaaagggatgatttaagacacaaaaagcaattgcaacaaaaacaaaaattgacaagtgggacctaatttaactaaagagcttgtgcacagcaaaagtaactaccaacagagtaaacagagaacctacagaatgggagaaaatatttgcaaactatgcacccaacaaaggtctaatatccagaatgtttaaagcacacaaatgaattaacaagcaaaaaacaaacaatcccattaaaaatggggaaaggacaggaacagacacttcccaaaagaatacatgcatgtggccaacaagcatatgaaaaaatgctcaacatcattaatcattagagaaatgcaaatcaaaaccacaatgagtgagataccatctcacaccagtcagaatggctattattaaaaagtcaaaaaataacagatgctggcgaggttgtggagaagagagaacacttatatactgctgtcaggaatgtaaattagttcagtcactgtggaaagcagtttggagatttctcaaagaacttagaactaccactggacccagcaatcccattactgggtatatacccgaaggaatataaatcatgatgccataaagacacacacacacacacacacacacacacacacacacacacacacacacacacacgtgttcatcacaggcactattcacaatagcaaagacatggaatcctactagatacccatcaacagtagactggataaaaacaatgtggcacatataccccgtggaatactacccagctataaaaaagaacaaaatcatgtcctttacagcaacatggatgcagctggaggctgctatcctaagctaattaacacaagaacagaaaaccaaataccacacattcttatttataagtaggagctgaaacactgaatacacatgaacacaaagaatggaacaatagacacaggaacctacttgagggaggagggtgggaggagggtgaggatcaaaaaactacctattgggtaccatgttcgttacctgggtgacaaaataatctgtacaccaaacccccaggacatgcaatttacccatgtaataaacctagacatgtacctcctgaacctaaaacaaagttggaagggggaaaaaaaaaaagagtaggtttgctttaaaaaaaagaaaaaaaaaaaaaaaaaaaaaagaaatgcctgatgccacacctctgacttctgttggggcagggatcccctgggatgggtgtataagccttccctcttgtcacaggtcaaaggatacgatcagaaagggctactttctgaaaatcatcagttagataatagagccagaagtggtcattaataatggtggtcagaaaaatcatgatgtgaagccaactagaatggaagaagtcagtgcatatcaagaagaaccatgggccaggcacagcagctcacgcctataatcccagcactttgtgaggccaaggtggaggatcactcgagctcaggagttcaagaccagcctggtcaacatggtgaaaccccatctctactgaaaatacaaagattagtggggtgtgggggcatgaacctgtaatcccagctgctcgggaggctgaggcaggagaatctttgaacccaggaagcagagactgcagtgggctgagatcgcaccactgcactccagcctgggtgacagagcgagaccctgtctcacaaaaaggaaagaaagaaaagaaaggcagaaagaaaggcaggcaggcaggaaggaagggaaggaaaaagaaaagaaaagaggagtggagaggagaggaaaaagaaaagaaaagaaaagagcgagccatgattacaaggtagcaagataaaaaagtaaatctggattcataacctacagttgatacttgaaagtactttttatgaacttgtaggcccactttttggtggataaactagatgtattgactggtaaagaaattagggtataaatacacatggtaagcctggcatcaactctaattgttccttaaaaagaaaaggtgaaaaccttagccaggttttcctctcgtagtacctgagtctacaattcactacttctcctcttgtcctttgttctttacatgccaatttggagtggtgtcatctttgtaacaggggtaattaaccaactctacaaaagtgtcagactgtcaccaattgtctaacatcttctagctcttgccattaccaattagctccaattctgttctgtgctgtgttgaatatagtaggatttctgtcttccaatgtattccttgcaaatatgggctgcaaataacttcacagttatcttagaatggttcccctctctgagcagcagtgtaggagatggagttgtcactccgacttcccttaattctcaaagaggtagaacacattctagaatgggtgttattcaaaagaactgcctaccagaagacattgcctctgattttcttgtcacagaaacattttctctggctacgccgttgccatgtagtcattttatactggatcatgtgtgggctagagtagccagaattctatttttctggaagataaaggcagaaaattctgtcactgcattcattccaatctccaggatcagagagtacgagagttcttcattcatcttgttagtcactcaacccacagtactaactgagcacccactatggattctttatggattgctgaagtaggtgttgggagacggtgatgatgatggagaaatcaggaatgttttcctgagtaaattctcatctcaatggacagacaggcccaacaaacccccaaagcttgtcccagaaaaatacacaagtactgtgagcgatttattaattcattctcattcagctcctaactcactcttccatgcgctggttcgtgatgtggaggcagggcttcttcaatccacatttctgcttttctagttggagccctattaggctctaagggggctgcagagctggaggaagcaagagcgagttgcttctttctgtctgctccctctgaggatttctccaccaacacttcacttctgcagtggcagtgtctcccgtgacagcagctgaatgcagtttacagtttttccaagccgtgtgggatcagctttattcataaactccagaaccaaccatcctcagaggtctgggcttcaactccatggagactcctctgaccatctaagtttcaagagtattaagaattccaacctcttctttttgttttcctaggcctcaggggtgaagttgctttctgtagtttttccctccctgattccttagtgtgttctttcagtctttttagtttcttagttaacagtgctataccttgttaacaattctttttaccgaggtacatatttttcctgttaaaataactgaagagatttctgcctcctcactggaaattgagtgatacaaaatcccaagttactcagcctttccaatgcaacaggtttttggaaaccctctgaacagtcagattgctataaaagcccactgagtactcacacaggtgaattttccccttccctgtccaaatgcaacatcctcagcaatctttgaataagtacacaaagtcatgatatttaaaatatgtacagtaacatatagcatccagtgatgtacaaaaactcaaaactatgtatacaaatctgggacttcatgacagtgagtccctacttgacgcttctgtggctcacagtggacaaagaagccttacaacctgtctttaataagaatctgcttggccaggcgcagtggctcacgacggtaatcccagcactttgggaggctgaggtgggtggatcacctgaactcgggagttggagaccagcctgaccaagatggagaaaccccacctctactaaaaatacaaaattagctgggtgtggtggtgcaagcctgtaatcccagctacttgggaggctgaggcacaagaatctcttgaacccaggaggcggaggttgcggtgagccaagatcgcgccattgcactccagcctgggcaaaaagagtgaaaccccatctcaataaaaaagaatatgcttgatggttgtactaggagcctcctggaaatgcggctataccctggctcgtactggcaggcccgttctctattcctgtgtttaggcttcactactgggtttactccatctgatttttgggtttggtgtacaaaaagcccctgccagcttcctttcctgaaaagctagagcctggtgtttctacctggtcaggctctgcctccaccggatcaacttccccggaaaaacttgcaacccagaaattcctgctgccaagatctcagccactgcttaaatcatctggatgacaatgacacacccaactcttaagataaatttactacaacctaaaacactgactatatagctcagtcaatgcttctagagtctccaggtttcagcttaagcctctgttcttccctgctcaaagacagagttggtcaagtgagtctaccaactaagaccacacagtttacagcaatacagtccttcactcaattccctttgaacacaggctcatatttggaaccactgggatctgcaatgtgtggccatgcaaaaatcttccatgtataatccacgttatgtaaagattgttttcctgggaatatgatgtgactctagcaagtttttaacagagtacacttgggccaggaaggttctaggcataagcgagcattgaatgaggagagattacaccaggagtagacccattctcaagtacaaacttgatggtaaacaagaagcaaaacccacctcaatcaaaagatgtgtccccatcccacacctcccagctccaagagagagttaatgatatgatcatctctgtttccctcccaggttcccaaagatctgaaggaaaaggaatgaattccaatatctgcctccaatttccccttcatttccttgcaatctgatgcatcatgacacttgttttgatttttatttttgaacacagccaggctcattcacttacatattgtctatggctacattcccattaaaagggcagagttgaatagtcgtgacagaggccgtatggcccacaaagccaaaaataatcactatcaggcccttcagagaaaaaaaaattgtgggctgggctgtgtgttttactcctgtaaaccctgtaatctcagtgctttcggagaccaagacaagaagatcacttgagccccagagttcaagaccagcctgggcaacatagtgagacctcatttctacaaaaaaaaaaaaaaaaacaattagctgagcgtggtggtgcacacttgtagtcctagatgcttgggaggctgaagcaggagggtcacttaagcccaggagtttgaggctgtagtgagctatggaggtactactgccctccagcctatgtaacagagtgagaccctgtctcaaagaaaaaacaagaagcagcagaaagaaaagaaaagaaaaagtttgtgaacccatatttattatcacttttggatatatatcctactattgctatctgttttaggatgatggtgagggacatacaaagcgagtggcttagcaatagctgaccacatctgaagctttgacaattatatcatgatcatttcctagcaggcagtttgtactacctgctcctgtggcaagcactttaataagtgttattatatatatttgtaataaccataacacatcttacttactcgatttttatagatgggaaaatatagtcagagaagtttagtaaatttcgcaaggtaatacaggcaacaactggtgaaagcaggatacatatcttaaggtaatccattatacagggcttctcaagccttaatgtgcatatgaattatctgtggaccttattaaaatgcagattctgattcagaacatctaggatggagcctaagattattcatttttaacaagttcccaggtgatgctgttggtttgcagactatactgagtaacaaggcatcatatctatactgtgccttgttgaactgatttaattggaaaaatgttccatctttctacctaaatcaaagcctgaatgacagaatcagggatcagagttggaaggactaatttaataatagcagcattaagaatagctaacattgacatgttattatgtgcgcttgatgtgaattgtctcatttttatactgacaaccaccctagagataaatatcattttaacatcattttacaaaagagaacagttagtcacagagcaggtaagcaacttacccaatgtcacaccaatggaggagatgaaaatctaacttcagtctatctcatatggccccctgctcataatcactacactctgctgcatcttattgcatgtgtctggttacataacaaagacaagtgttagcctcatctttaagtgaggtcagcctctgtctttccagccactcttatctggactcacaaaaaccagcctcctccatcaggcttgatgatggcatgaattttattagcaatcttggcccaccttccaatggagttagaatcagtcttgctctcacagacacagcaccaagtgtaccacatgggttctgtctcactcgcataagccctagcctgggttgaagcagtctataaaacaaccttctatcctgtttccttctaccaaatattccaatgttttattgacaacaaaatatcaacttgaaccatagcctgcttgagtgggaccctgacacctcaccaattacttgtttctgagagtttcataatcccagtggctctctgaatggcacgtcgcctgtgttccattggcctatatgcctacctttaagccaatactatattattatgattattgtagctttgtaatgtactttgaaatcaggaagcgtgatgttttcacctttattcttctttctcaagatcaatttggctattcatggtctattgcggttccatattaaaaactttagaattgtttttaatatttctgtaaaaaatgccactgggattttaataagaatttatttgaatctgtagatccttctgggaagtattgacatttgaataatattaagtcctccaatccatgaatacaggatgtccttccatttgtgtcttctttcatttatttcatcaatgttttctcattttcagtatacaagtcttcacctccttaatcaagtttattcctaggtattttattctttttggtgctatcataaatgagattgttttcctaatttccttttcagattgtttattgttagtacatagacatgcaactcatttttgtgtgttgattttgtatactgctaaataaatccatgcatatatggtcaactgatcttctacaagggtgccaagaacatacaatggaaaaaggatagtctcttcaacaaacagtgttgggaaaactggatatccacgtgtgaaataaggaaattggacccttatctaacaccatacacaaaaatcaactcaaaatggggcagacttaaacataatacctgaaactgtagggatactcatatatgtaatctatctatctatctatctatatctatctatctatctatctatctatctatctacctacctacctacctacctatctgggactacatcaaactaaagtgcttctgcatagcaaaggtaacaacagaatgaaaaggcaacctatggaaagggagaaaatatttgcaaaccataaaaccatatatctgataagcagtgaaacctcaagatacacaaataactcctacaactcaatatttttaagaaaaaaactactaacccaattaaaaaatgagctgaggacctaaacagacattttttcaaagaaggcatatcaacagccaacaggtatatgaaaaaaaaagctcaatgtcactaattatcagggaaatgcaaatcaaaaccataatgagacaatacctcacacctgtcattagtctactgtcaatagactaatagactgtcaatagtcattgactattgactattatcaaaaaaaacaaaagacaagtgttgaggaggatatagagaagttggaatccttacaccctgttgattggaatgcaaaataatgtagccattatggaatacagtatgggtttctcaaaaaattacaaatagaactaccatatgatccagcaatcccacttctatttacgaaaataactgaaatctgactctcaaggggatattagcattcctatgttcactgcagcactgtggaaacatccaaaatgtccactggtagatgaatggataaagaaaatgtggtatatacatatacagaatagaatacaatttagcttttcaaaagaagaaaattctgcaatatgctacatggataaaccttgaggacattatgctaagtgaaatcagccagtcacagtaagacaaatactgcatgattctactcatatgagatatctaaaaaagtcaaactcatagaatcaaagagtgaaatgaaggtttccaggggctgggagggatgagaatatgtaagagtaattaacaagcataaagtttcagtcaagcaagatgaataagcttcagagatctgttatatcacattgtacccacagtcaacatataatatgttgaaatgtattgtaaacgtaacaatttattgagagtagattgcatagtaagttttcttaccataatactaatactaataataaaaccatctatgttttaatcagtgtttgccagtcatgaaatctgtgtcactctatgaagagaatgttcagatcaaagtcagatagtctagaaaataccacttaatgttctcgctgaatgatctttaaatagccacacacattaattaattttctgccatacttcactggggttgcaatctttttcagcaaattgagacagagactccataatgagaacaaaactatatcaaacaccatttcagcaaaaattgaaaaatcaaaagtgataatatttctgaagtaatggctatgttgaaaagagtaaatgccatcaaatgcatctattttcctgtcaagtgctgtaatgagactagctgagaaacaagatgccaaattaatgccccttaaaggctgttgcattttcttccatcagttttcttctcctatcatttaggaatatcaataaactcccaaagagaagctttggcagttaccactgtcattttgtgtttctcttcccctcaaatgattcttactaaagacttcagtcacctgctatctccctctgtagtaatgtgcatcgaaaagaattgagcataagcctttgccccaaatcctcaatttgaatagtttcatcaactagaagcagttctgaagcccctgtggaaggcaaagtgcttggaaatctaagattcttacagttccatatattatttactttaacaatttattgagatacaattcaccttgcaagtcacccatttaagtgtactattcaatggtttttagtacattttcagagtattgcaaggatcaccacaatctaattttagaacatttaatcacccaaaaagaagtcactacccattattcctcccacctcacttccaagctcacctcacctcctgtcccgatcccccagcactaggaaaccactaatctactttctatatatagttgacctttattaaaatttcatataaatggaataataaaatatgtggtcttttgttactggcttctttcacataatataatgtttgcaagggtcatctatgctaaagcatttatcaatacctcattctttttattgctgaatattattccattgtgtgaacacgccatattttcttttttttttttttaacctttaagttcaggggtacatgcgcaggtttgttgtacaggtaaatttgtgtcatgggattttttttgtatagattatttcatcacccaggtattaagcttagtacccattagttatttttcctgctcttctccctcctcgcaacctccaccctccaataggccccagggagtgctgttcccctctatatgtccatgtgttctcatcatttagctcccacttatgagtgagaacatgtggtatttggttttctgctcctgcattagtttgctaagaataagggcctccagctccatccatgccacattttctttatgcattcatcagttggcgaacatttggattctatttacttttcggctactatgaataatgatgctatttacatccatgcacaagttgttgcatgaatatgttttcatatcccttccacagatacccaagagtggcattgctggggcatatggtaactttatgttcaacattttgaaaaactgccaatatattttccaaagttaccacactattttacattcctaccagcaatgtatgaaggttcaaatttctccttcacatccctgcccaaaacttcttgttgtctttttgattatagccatcctagttggtgtaaagcagtatctcattgtgggtttgatttccattaccctaatgaccaatgattttgaacatcttttcatgtgttcttggccattggtacactttctttgaagaaatgtctagtcagatcttctgcccatttttaactgagttatttgtctttattattgagtggtaaaagttctttatacattctggatacaagtacctcatcagataaattatttgcaaatattttctctcattctgtgggttatcttttctgtttcctgagagcgtcctttcaagcatacacctcatcctgcttttgcaaagttcaggcagtctgaatctgccacaggtgtgttggtaaatactgattgactgccaaaattatattgattccttcttgcccttaggaaaatatctaaacacttcattatggcattcatcttttgtaatctggcccgacccttctctttaccattactccctgcctttccccctgcccgcctgcacccaatggaccttaagcccctccttcaagagtcttttcactctttccgctgtctagaatgatccctccctgcctgccttttctccaaccatagcccccatgcctctccctccatatatatacgtactcatagtatttctgttcactaggtaaacccaccatctctaatgttcatgcttggatatacctcaaggaatatacttgagatacacctttcttggcttcctcggcgaagttagatactctgttcttggtattcccacggcattcttttgttcatctctctcagaaagcacttcacatatcatagcataatatgtcattcccctacgtgggcattttcccacaagactggtacaattctcctaaactaggatgttgcgagatttacttctggcacatagtaggggcttgcagaaactatcaacgctctttaaaaatattccagtttccttttcctttcaggcagacagttagcttgcatttgcccagccctttaaagttagggatggctgtgtggccattttggctaatgaaatatgaacagaaatgacatatcattaaaatgaggaccctttaaaagccaatgtgctatttgccgagctgtgttttcttactatagtgatcatgaaagcataattaagatgaaactgagtcagtgaaggaccacaatcagcatagtaccatgccataccacagtagacatgtactatgagtaaaacaaaaaaaatgtgtgttaagccacttcagtttagagactctgttaccacatcataacctagcctctcctgactagtgctggactaaatacatgtctgttgaaagaatgcaatgaaaatgcagtgcaggtcactatctctttagtttgcctataatggagtaaatcactcttctcttgctttatctcagtatgtatactgttaaataaatagcaatgattgcttcctaaatgtattctacttcactctactagtagtctgctaaatttgaatgtaaagcagaactattttctccttgcattacaaatggaacatctgaaagtcttcacaatttccaattcttatttcttgaaagtagcacactggattactcttacaacaaattttttaaaaagcattcaaaaataccctgttaaaatgtaccttctgaggcagatactcctgacatacagctgcatttgacttcaaaatttatcatgggaataagcataaattgtttatacatggatcatagatatttatccctatgaaaacatttggctttggagaatagtctgagagaagctgtctgggggttgaggtgggaagtaatgtacatggggttatagagtagcctttttcttcagcgatgcttgcagagaattcttttttagagttgaggattctcaaaatgactatgtcatttaagcacacaaaattagtgacttttgaaaactatgatttaaattttctggtggcaagcatatctaagtggataaatttataaataatccagtttattcctgagtcactgttgacctgtatactcagagatgatacctttctgttttgttcagccacttacttttgtacatatctcaatgtttgcactttcggctgaattttaatcgtttgattatatgtctgtctttggtctgtgaaaaacacattttaattattcatacattcctcatagaaaaaatagacccattttttaattgattaaggggttgcatgcatgagtgatgagtgaatgctaagttagttgtgagactttgagcaaaccgcttttagtctctctagacctgagctatccaatacaatatcgactagctacatgtggccagtaagcacctgaaatgtggctacatgtgtaaaatacacatcagattttatgtctaaaatacacatcaaattttgaatacttaataccaaaaaaaacctcacaaataacagcgttcatattgattgtatactaaaataataatgttttgggtatattaggttaaataactatttaaattatcacacctgcatctttttacatttttttattttcaaataattatagagtcccaaaacaattcaaaaatattacagagaggttctgagtgcctttaaccagcttcccctctgataacatcttacataactacaatacaacatcaacattttaaaattgacatttatataatacacacgccttattcagacttcaccagtttgacatgcatacattttggtgtgtgtgtgtgtgtgtgtgtgtgtgtgtgtgtgtgtgtgtgcatgagttccatacaattttattccatgtgtagctgcataagatcaccactaaaatcgagatgcacaaccattccatcaccgcaaagatctcccttgtgctactcctccataaacccatccttaccctaacacctcgtcagcaaaccctagcgaatcacaaattctccacctctataatttcttcatttaaggaatgttatataaaagaatcatatcatgtatccttttgaaataggtttttttccactcatcataatgtccttgagattcatcctagttgttgcatgtatcaatagttgttctttttattgcttagtcatattcatgggatagattaccacagtttgtttaacaacccagtgctggcgatttgggctgtttccagtttgaggctattaaaaataatctgctatgaacattcatctataggatttgtgtgaatgtaagttttcatctttatgaaatgaatgccaattatgaaatgaatgccaatgagtgtgactgcttggtcatatgttaaatacatgcttagtatttttaggaaactagttgtttaagaacataggtgtatagtgatatatgattgtggttttcatttgtatctctctaatagctaataatattcaataccttttcacgtgcttattcgccatccatatatcctcttgtaaaatgttcatttctcttgctgattttctaattggattgtgttttttatctgtttcttctggtttttttactgttgggttttgaaatatttttgcatattttacatacaagtcctttgtcagataagagatttacagatattttctcccaggttgtaggttgtctttccatcttcatagcagagtcttttgcagagcaaatttttaatttcaatgaagtccaatgtatcaactgttttcttttgtgaattcctagatcccaagtatttttgtttcttctaaaagatttatagctttacattttgatccactgatccgttttgagttaaattttttaagttgagaggtttaggtcaagttcccgtgtttgtctatgggtgtccaattgctccagcaatgtttgttgaattgcttttgcatctttgtcaaagggacatggttgtttcggtctatttctaggttctacattctgttccattgatctataatattcatcccttcactaataccagtcttggttaataaagatttataataagtcttgaaatcaggtagactgttttctctttattcttccctttcgaatttgttttagctattgtagttcatttgccttttcatataaactttagaataagcttgcatatattcacaaataatgttgctgaaattttgacaggaactgcattaaattgggggagaaattatatttttactatattgagtcttccactccttgagtatggtatgtttttctctctttattcagatctcggacttctttcatcagcatttagcaattttcagtatacaagtcttgtcatgttttgttagatttatacttaagcatgtcattactgaggagttattgtaagtggtattgtgttggggttcttttgtttgtttatgtgtttttgagacagaatcttgctctgtcgccaggctggaatgcagtgacgcaatctcggctcactacaatctctctctcccgggttcaagcaattctcctgcctcagcctctggagttgctgggactacaggcacacagcaccacacccggctaatttttgtatttttagtagagagagagtttcaccatgttgggcaggatggtctcgatctcttgacctcacgatctgcccacctcggcctcccaaagtgctgggattacaggcgtgagccaccgcacccagctggtattgtgtttttaattatggctccaacatgttcatcgctagtctgaaaaatacaattgatttttgtatgttgattttgtctctgcaactttgctgaacctacctgttagttctaggaggtatttttgtagattcctggaaattttatatgtagattgtgtcatcggaaaataggaacaattttattgtttctttcctaatcaacatgcttttctttctttttcttgccttattactctagctgggattttcagtagtgtgttgaataaaagtggtgaaagtgcctgcacttgcattgtttacaaacttaagtgtaaagtattcagacttttactattaaccatgttactgttacaaagtacatgtacaaagtacaaaaagctgtggtctttttgtaaatgtcctttattatattgaggaagttatcctctattcctagtttggctagagtttttatcataaatgggtgttgaattatgtcacatgctttttctgcataaattgatgaaatcatgcaatttttctactttagcctgttaatgcagtgttttattaaagtgacaaatttttgaatattcaaacagccttgcatccctgaaataaactccagttggtgtatgtgtgtatatatgtgtgtatatacatatgtatggatgtacatttatatattgctagattccatttgctaactttttttgaggttttatttcatctgtgttcataagggatattggtctgtagttttctctttgtttgtactggatttgtctttttccagtctcagggtactattagcctaataaaataagttgggaagtgttccctcctccttttctatcttctgtaataaaaacattgtagaatatgtgttaattcctctttaaatgtttaaaagcacctaggagagaggatatattttgagagacttttaaaaatacaaattaaaaattatctattggacagagccatgtgtagatcttagcctttgcacttgcaaatcaaagctttacaagagatgctctccaaagtcaatcctttacacctctacaaccccatgattttaagaattgttgtttgacttctttatgcaatgcaaaatgatatagataatcttgtttatctttctacttacctacatcatagttatcagaaatgaaatagttctggaaagcccttcaaatgcctcaaaatagaggcaaggttattattatttttaaaatgaataccaatatgttaacatttctataggaagtagttggtaagcaaggatttctctgaaggagcttattgcaggtgctaatcagctcacactattttttactgtctgtgctgaaaaaagaattaattacttcagtaacctcacttcttcacatacctaaataatgcatacccctattctgtggagaataaactaaatttgatagagaaaagtttaatgcgtagctaaagatagcactgtaatctccttgaaagaactctcagcactctcctccctccttttaaacagactttccttttctgaaactgctaatgaatggttcttgtatccttgtgattccctctctcattgtatatcctcccacatatttccaaagactattaaagttcattttcttccaatattcataagtaattttcctgaagtccattggatccttaccagaacaattgcaataacctgtccccgaaagtcttgttttctagaagcattgtttaaaattaagacattgcctttgagcttcaggtacaagatacataaagttctcactccatcactacaaagttccccagtggtctagtcatctctcattgaaattgtttcccttaaaatacgtgtttctccatcattctacaaaaagggcatttttttttttttaagacggagtcattcactctgttgcccaggtgggagtgcagtggcacaatctcagctcactgcaacctccatctcccgggttgaagttattctcctgcttcagcctcccgagaagctgggatgacagatgtatgccaccatgcccgactaatttttgtatttttagtagagatggggttttgccatgttggccaggctggtctcgaactcctggccccaagcaatctgcttgccttggcctcccaaagtgctgggattataggcgtgagccaccgcgctgggccaaaaagggcattcttgaaggtcattgatgattttcatctccaaaactgagtagtctacctccctcctgtcattctgaagaattttatattgtttaccaaaactcctcgacaagttctcctgccttatttcctactatgtagactctctcttcacctaccttcctgtttttctcttctcattatctaatcatatgaattctatggttccttaaaatgttcttaaacctgtctttcactactgtctatttgttcaagtattcaattagagtttcaactataacttctatgctgactattctcaaatctctcttcgtcttctcatctgaactacagtcccaaatctccaggttcagttagcatttttacttgtatgccccccacaacaccacaaactggacatgactgaaaccaaactcctctgcttcccctccgcctttcctgtcgaatggcttcaagattctctgcttcaataagtctctaacctggaagactgagtcatctttaattaaagactctttttatctgagaaccaggcaccaaatcaagcacattttttccctagaaactaggattaggtggaagggaaaagaccttgaagctaaccatatccacgtttaaatttattcatgtttaaagttatttaccgtaactttgcatgaacttggatatattatctaacatctctgagcttcaatgttttcacatgaaaaagacggaaaatacataccatgaagttgctgtggtaatttaatgagataatacacttaaaatgtttggcatatagtagaactcaaaaatgttagttgcttctcagacgtgatttttctatctgttccattctccgagttcccactgctaaactaccacactctgttcaagtccctcagtcccatgtacttgagatatcaaaaacaaagcccccatttttcaaccccacttccctgcattctactttctccaaagggacccacttccttcattaatgtcatatgactccttcattctaagtttcccactgttttaccatattaacttgatagttcattgactgtccttaaggttcctaaaagttcccttttcctttcccctgacccaaaccatccttctccatttcccctttctccttaacctgaattttttgtcctagtcctccaggctgccctgatttcttcccaaaggccacacttgttttttttccctgaaactttaacatccttctatctctaatttcatacctcctatagtatcagatcaaacccactccccttataggtctttgcctcaactctccagcctctccaacctcccttcggcccttcttgcctgcaaccattattaacacctaatagcattctaatttgtgtttgttgggctaattgtcttagtctggccaggctgctataacaaaacaccataaactggatggcctataaacaacaggaatttatttctcacagctctggagtctgggaagtccaaaatcaagttaccagcagacttggtgtctggtaagggcccgcttcccggttgacagatggccacctttccattgtaacctcacatcacaaaaaaggcatggggtttctctcaggcctgttttacaagggcaagctaatcccattcatgagagctgtactctcatgaccgagtcacctcccaaaggccccatctcctaacaccatcacctttggggttaggatttcaacataggaacttcgggggaacaaaaacattcaaaccacattcgatgttccacatcagtgcttacaagcacttgggtttcatacaccaataacatttcaaagcctaattaggctactggccattagatttacattctttcttgccctaggagagacctttaaaaataatttgaaatccttatttcattttaaaagtatattttacaaaagatagtagggcataatgttagaataaaaaagtttacattgaataaatttagatttgggtaaaaaagttctattatccttgttttttttgtttgtttgtttcttttttttttttttttcattttgatatggaccagaggaagctatcaggaaaatccttggacagggaatctccatgattgtctctctatacctactgtttctgtaacagggataattgatacttggagagttcctactatgaaccaattagtaaaactttgtgtgtgcctgtgtgtgtgtatgagacaggtactagtatgccattctacagacagcaaaactaaaacaattttctcatgactcacagtgaataaatggtgaaagtgatatttggacccagttatttaaggtccagtgttcttgattgctaactacaccacactgctgctacttctttagactctgtggtatgagtatgattctatatacaaaataaacataccaatatgtacaatgataattgcaacatttgccataatatagcacacctattgaacagaataatggccagatatatatcatcccaaggaaactacttccataaagagtatttataaattgtaaagtgctgtacagatgcaaaaccaactgtaattattatcatcaacagtgctaactggaattccataagtcaagtttgccttagaccatcacagcagatttattaaataaaacactatcactatcatttctaagggagtcccatatatgagactattttaggccagcaacattaactcatctttaagagagttttgaagaaatcggagtgatggcaaattagcccaattcactgcctgcaatatttcactctcttactgttgcctctaagattatagggactgccctaagcaaaatggtagaaaccgtcttaaacatactcttgtctttccttacataaccctttttatcttaccttgggggaaactttacacattcttcccatctttcccactctctgccctaaaagaatcttttagccagctgttccactggaaagcatctaaccgacaaattcacatttttgtgttttgtttttccaggaccatgctaataacataccaagccataagccatagagatacatatttagtgagaatatttcagatacagtgaataaggccgttgtagagatatttagagcaaagaacatcacactggtggcccttaattgagctgacaaatattttttccaactgatacgggcaattgtaaatggtaatgaatcatcctgaaagcacaatccctctcagtatcttcaatacccacaagtcttctaccagttctgtgtcatcacagtaattcaccacaatgagttccaccttaaagtgcactgctctctacccagattttacaactacccctctcccaacaatatgacttttcttcacttcactttcatggcctcttctatttttctgtatcacccacaaaaaataagaatagaagcaagtcacttcgtagtaaaggagtaatgtcctgtactattttcccgactggccacaagtcaacaaatggttctaaatttttactctcaataatttgctgagtaccttcagtcaattccagaaagattttggaacctcaatttcactctctgtaataagggagaacaaaatgacctctgatgtacccaacacctgtagaattctacagttctgtaatattaactattattcaaagtaaagatgaaggcataaagacagagaaacataatacatccttcaagaggtaaaagccacgtgtaactaaacaaatttccttttaaaataatgaataaactagaagacattgagaatgccttaaaattcctaatacaattcatggagaagtatggaggagttgtaatgtgacttgatcagaatatatccggttcaacaaccagatgaaaaaaaaaaattggtcaggtaatttgtatttatccataccagtggtttccaaaatacattccaaagaacactactaattgtaaaaaataataataaagattgcatttaaatgcaaactgagcccttgagggttgtctggacttagtgactcattccacaaaatagagtatggaaagggagaaataataattttacagtgtagaaaacttgaataacacaaattatccaagggaccgaggttgaccttaccaatgatgggtcacgttgacatcaggtacctatctccccagtatgatgtgatgagataggctcttcatctctgtgatattttcttccaaaagcccataaccccagtctaatcatgagaagttacatcaagcatacctttttgaaggacattctacaaaattcctgatcattactcctcaaaactggaaagattatgaaaaataagaaaaaactgagaaactctcacaaactgtacataactaaatgcagtatggtgtcctggagtggaacttgaaaccgaaaaaatacattaatggaaaactggtagcataaagtttggaatttagctaatggtaacacaccaatagtgttttcctatatttgacaaatgtatcatgataatgagatatgataagattagaggaaactgaaactggctgaggctatacaggaacctctctgcactacctccgtaactgttctgtgaatctgaaattattccaaataaaaagcttatttaaataattgatgaagatatccattagcaaattcgtttggggaactttggattaaacaactgatttttctcaatgtctgtaaatatcatagctcctaaaatatccaataagcattgtgattttaacagagagaatatagggtgctgtgtttctcaaacatatttgaccagaaacctttttatttcttcaaatagcatcttttacaaaaagtactgacacagagaagttttctcccaaggtgtcagacttctgtcctatactagaccatgatgaaattttaatcagtgactgactaaagagacaaagatgctatgaacattaaattggcagaagacttgaaactagagactaatatgatggatgacagaataatcattaaaattatatttcataggttacatcaattgatcaaacttaataagatgactataaaaggatacatacatagtcttcatttaggtaagcaaattaaaaaaaaaatcagctgagtaagtaaaagaagcaagaacttaaatgcacgtcatgttactgtgagcagctttgtgtctcaggagttcttaggtcaaattagtagaattgtcatgctcagtaaagatgccctaatagtaggagtaatgccatttctgcagattgtttgcttgtcttttcctgttttttagttctgcgtgctacattgtaaatggtcctcaatgaaccatttccaaaggagaggcaataggatgatgtgtgtcttggaaaccatgtcatagcaagaaacgtcgaagaaactggaaatgttgccctgatgcacagaaaactttgacagaggctgggcgcggtggctcacacctgtaatcccagcactttgggaggccaaggcgggtggatcacctgaggtcaggagttcgagaccagcctggccaacatggtgaaaccctgtctctactaaaaatacaaaaaattagccaggcttggtggcaggcacctgtaatcccagatactcgggaggctgaggcaggagaatcacttgaacccgggaggccaaggttgcagcgagccaagatcatgctattgcactccagcctggccaacaagagtgaaaccccatctcaaaaaaaaaaaaaaaaaaaaagaaagaaagaaaagaaaaagaaaaaaaagaaaactttgacagatcctttagtacacaaggatacaggagaatcaagcctattctgtataacttcagaactcagaaggacttaaggacacaggaagccgcacgttttggttcaaaaaacttttgtaaccattaaacagcctcataatggaatggatatttttgaaatgaagtgagctccctgcctctgggagtgtctaaatggaagctggatatccctctgtccagactgcagctagaatgtcttctacgtgtacctaataaatgagttctacacaaccttccagtgctaaggtctcagaagctatcaaaccacagggaaggaaaaaaaatgaagaggcactgagaaaagtgacaaaccactaaaaacagcccctaaagtaccttaggcactgctttacctctcttctaaccatcatccctgtaataatatctggaaactgcctaaacaagtgttgacatttagttgatgaattaaggcaaaacgctgtcctagagtgtgcacctaagagatttctgattagtagaatttaagttacactagaggacagggaatgatgaatttatcctgacaaagtactgtattcactccaaaagaaatttaccaaaataaatgaacacacgaatatataaataaatagttttactttaaatgcattatttttttctcttagggaaataactggcttatataaaggacaatgtgtatatggtgtgtatgtttaaggcgtgcttcaaggttgctctcaagctgagccagaactatcacgagaagagtgaaaggagcacccgggacgcagaagttaaggaggcagttactcctagggtcctgtaagtgctggcagggtcagcccgtgagagtgagtgcctctttaaatttgcgtcacagacgcctgcttacctcaccccagtccaagccctgtgattggtcaggccatcaaagcctcgccccctacacgacccggaattcgacgccaacactggtttctggggcaacttctgcgtagctatgtgactagcacccggaaataattgccaccgccatcttttggtgcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcagcagaggcagtggctggagtggccccttcggccatcagggaccgagagcagcaggctcccgtgaaccaccactctgctttaaaataaagaacaatatggttggtgtggtcattggttacagtggatcaaaaataaaagatctacaacattcgacaaacactaaaatacagatcataaacggggaatctgaagcaaaagtcagaatttttggcaatagggaaatgaaagcaaaggccaaagcggctatagaaacacttattagaaaacaagaaagctacaactcagaatccagtgtggataatgctgcatcccaaacccctattggaagaaatctaggcagaaatgacattgttggagaagctgagccattgtcaaattgggatcgcattagggcagcagtcgtggagtgcgaaaagagaaaatgggcagatctaccaccagttaagaaaaacttttacatagaatccaaagcaacaagctgcatgtctgaaatgcaggtgattaactggagaaaggaaaatttcaacataacgtgtgatgacttgaaaagtggtgaaaagcgtctcattccaaaaccaacttgcaggtttaaagacgcttttcagcaataccctgatcttctgaaaagcataataagggtagggattgtaaagccaacgccaattcagtcacaggcatggccaattattctacaaggaatagatcttatagtagttgcacaaaccggaacagggaaaacattgtcctatctaatgcctgggtttattcatcttgattctcaaccaatatctagagagcaaaggaatgggcctgggatgctagtccttacacccactagagagttggctcttcacgtggaagctgaatgttcaaagtattcatataaaggtctcaaaagcatttgcatatatggtggtagaaacagaaatggacaaatagaagacattagcaaaggtgtagatatcattattgcaactcctgggaggctgaatgacctacaaatgaataactctgtcaacctaagaagcataacctacttggttatagatgaggcagataaaatgctggatatggaatttgaaccccagataaggaagattttattagatgtgcgcccagaccgacagactgttatgacaagtgcaacttggccagatactgtacgtcaactagcactttcttatttgaaagatcctatgattgtttatgttggtaatctgaatctagtggctgtaaatacagtgaagcaaaatataattgttaccacagaaaaagaaaaacgagctctcacccaagaattcgtagagaacatgtcacccaacgacaaagtcatcatgtttgtcagccaaaaacatattgctgatgacttgtcaagcgacttcaatatccaaggcatatctgcagaatcattacatggcaacagtgaacagagtgatcaagagcgagcagtagaggactttaaaagcggaaacataaagatactgattacaactgatatagtatcccgaggtcttgatcttaatgatgtcacacatgtatataattatgatttcccaaggaatattgacgtatatgtacacagagtagggtacattggacggacaggaaagactggcacatcagttaccctcatcactcagagagattcgaaaatggccggtgaattgattaaaattctggacagagcaaatcagagtgttccggaagatcttgtagtaatggctgagcaatacaagttaaatcaacaaaagaggcacagagaaacacgatcaagaaaacctggacaaagacgcaaggagttttattttttaagttgaaaagttgtaccaggctactggaagattccaggcatgttaaagatatgcagtattgaatatatgtaaggaagtattggaaacatactagccatttgaagacataactaattcttaaataatactgctaaactttcaatattgtgtatgctccttaattttaaaaaagtctcaaaaatgagagagtgagagactgtgtgaagagaaagtgaatgttacgtgttggttaaagtttaatttctcttaaaaatacttttattttaggtttgggggtatatgtgaaggtttgttaaagaaacacgtgccatgggggtttatcaactttcaatattgtgtatgttccttaattttagaaaaagtctcaaaaatgagagagagactatgtgaagagaaggtaaatgttatgtgttggttaaagtttaatttctcctaaaaatacttttattttaggtttgggggtatttgtgaaggtttgttaaagaaacacgtgtcatgggggtttatcaactttcaatattgtgtatgctccttaattttaaaaaagtctcaaaaatgagagagtgagagactatgtgaagagaaagtaaatgttacgtgttggttaaagtttaatttctcttaaaaatacttttattttaggtttgggggtatatgtgaaggtttgttaaagaaacacgtgtcatgggggtttatcaactttcaatattgtgtatgttccttaattttaaaaaagtctcaaaaatgagagagtgagagactatgtgaagagaaagtaaatgttatgtgttggttaaagtttaatttctcttaaaaatacttttattttaggtttgggggtatatgtgaaggtttgttaaagaaacacgtgtcatgggggtttactgtacatattatttcgtcacccaggtattaagaccagtgcccaataattatcttttctgctcttctgcctccttccaccctcccccatcagctagaccccagtgtctgctgtttccttctttgcgttcataagttctcatcgtttgcttcccacttataagtgagaacatgtggtatttgagtttctgttcttgtgttaattttatagtctaccatgtccatttgtcttctctaaaacacttggtagaagacaacaatggtgcttttctggctttaaaatagttgtactaaattgaagcatagcttcaagcttatccagtcaaagtattctcttttcccccgagcagttggtgccacaacagttcttaaagttatttccactatcattctctacttgttttagttcattagaaaataagtgctaaattttttagaagattccacaattctatttttatcagaatgatgtcaccagcagagcaggatgtctgactcactgggattcaggtccttgtatgcattttgtcactaacccttggttaaaactctgaggaaatcacttgccttctctaggcctcaatttctctactcataaaatgggacagttttattaatttagaggtctcttttacctctaaaattcggtgacattataactaaaactgtataccccagccttgtattaacacttttttgtctaatctaggggaaattgcatccttgtataattgaataaaacaatccttttcaatgacaagaatagtgcattctgcatttttattgattttgcaatttaactggtaggttttcattttattctttgcttttcttttcatcatgctttattttaattcaatttgaaggtcaaaaccatatatatatagatacatatatcggggaaaaaattaaagtgaaagaaaaatttatctactgggaaaaacattaaaaccaatcaaataagggctgggtgcggtggctcacgcctgtaatcccagcactttgggaggccgaggcgggcggatcgcctgaggtcaggagttcaagaccagcctgaccaacatggagaaaccctgtccctactacaaatacaaaattagctgggtgtggtggcgcatgcctgtaatcccagctactcgggaggctgaggcaggagaatcagttgaacccgggagggagaggttgcagtgagctgaaatcgtgccactgcactccagcctgggcaacaagagcaaaactctgtctcaaaaaaaaaaaaaccaaaaaaaaaaccaaatgacgtttttgccataagaaccaattttagtaaaactcttcctaattttatctataattctacctcttatgccttatttagaagcaaggtgcttctcacacctgcaaaaagaaatccctacaaagatgttaagtaaactttaaaattcagtgttcatgaaaacattagaattagttaacatttctggtaaaatcaagagaaaaattaaggcaacaaacttttttccccagcatgccttacctgtgactacaaataagtcagaaaataagggaaagaaagaagtaaatgttctaggtataggtatttaaggcttaaagtatagactttaaaggctttttaaaatgtagaccttaatatctctggataaaattaataacaatggttaacattgttgagtgatacatacctggcgctttatctcctaatctctaatatttataagaacgccactcggaaggaaatcttacccctattttgcaggggatgaagcaaagtcagaggagctaacttgcctaagggccctaaacctgattaaagagaaattaagtgatatttagaggacttaagggatattttgacccggcagtgcctgattccaatatttatattttttaattttagtatagttattatgtttaaaggcaatatgcttgtcttgaggttctctacaagttcagatttagtgaaatagagaagtgtgtgcaaatttaatgcaaaggcaatctatagcagaactgtaatagaagctcaaatggcttagtgctgttcactcaagaggagaaatgataaatgtttagcaagttagagtatatgttattttccagaattattcttaggggcaatgctatatttgttagaaaagaatgcaacaactcaaccacttgagatagtatatttccataatcatgtgtaagtaacacttaacaagaaaaattatcactcaatgtctatgagtaaggaaatgagagatgtatgcatttcttctacaacataatgctggacagaagaaccagtgtatagagaaagataagtagaaatagtgcaatgactgttaaccaagggtgattttgctccccagcggaactttgacaatatctgtggacagtattggttgttacagctatgggtagggggtgaggtgctcctagcatctagtgggtagaggctgaacaccctacaatctacaggacagcccctcacaacaaagaattatctggcacaaaacaatagtgctgagatggggaacccctgagacagcataagaaaaacaaccaaaaccaactgcttagtaaccaaaaaggcacgtcaaagaaaaaaaaaaaatagagggtttctaagttatatcttgcgggttttgcagagaaaaagtatccctacaaacttcctgtctttggtgtagtctacatcagtggttctctaccaggcccaattttgtcaatgtctggagaaagatttggtgggttgttgtcttagtccattttcatactgctatgaagaaatacccaagactgggtaatttataaagaaaaagaggtttaatggactcacagttccacatggctggggaggtctcacaattatggtggaaggtgaaggaggacaaaaggtgcatcttacatggtgagcaggcaagagagtttgtgtaggggaactctcatttataaaccatcagatctcatgagactatcatgagaacagtgtgggaaagacccaccctcatgattcaattacctcccaccaggtccctcccatgacatgtgggaattatgagagctgcaattcgagatgagatttgggtggggatgcagccaaaccatataattctgtccctggcccctcccaaatctcatgtcctcacatttcaaaaccaatcatggcttcccaactgtctctcaaagtcttaactcatttcagcattaactcaaaagtccacagttcaaagtttcatctgagacaaggcaagtcccttccacctatgagcctataaaatcaaaagcaatttagttacttcccagacataatggaggtacaggccttgggtaaatctgcccattccaaatgagagaaattgcttaaaacaaaagagctacaggcccatgcaagcgtgaaatccagctgggcagtcaaatcttaaagctccaaaatgatctcatttgactccaggtctcacatccaggtcacgctgatgcgagaggtgggttcccatggtcttgggcagctctgtccctgtggctttgcagagtataccccctctcccggctgctttcatgggctcgaaatgagtctctgtggcttttccaggtgcacggtgtaagctgttggtggatctaccatcgtggggtatggaggatgttggtcctcttttcacagctccactaagcagtgctctagtggggactctgtgtgggggctcccaccctacatttcccttatgcactgccctagcagaggttctccttgagggccctgcccctgcagcacatctcggcctgggcatccaggtgtttccatacatcctctgaaacctaggcaaaggttcccaaacctcaattcttgacttctgtgcacccacaggctcaacaccacgtggaagctgccaaggattgaggcttgcaacctctgaagctgcagcccaagctctatgtcggtccctttcagccacaggtggcatggctgggacgaagggcaccaaatccctaggttgtacacagcaggggaacactagacccagcccatgaaaccattttgtcctcctaggctccagatctctgatgggagaagctgccatgaagacctctgacatgctctggagtcattttccccattgtcttgggaattaacagttggctcctcattacttatacaaatttctgcagctggcttgaatttctcctcagagagtgggttttgcttttctatcacatcatcagtatacaatttttctgaacttttatgctctgcttcctctttaaatgtaagttccaattccaaaccatatctttctgaatgaataaaactaaatgtttttaacagcacccaagtcacctcttgaatgtattgctgcttagaaatttcttctgccagatgccctaaattatatctctcaagttcaaagttctacagatctctagggtagggacaaaatgccatcagtccctttgctaaaacatagcaagagtcacctgtgctccagttcccaacaagttcctcatctccatctgtgaccacatcagcctggactttattgtccatatcactatcagcatttcggtcaaagccattcaacaagactctaggaagttccaaacctttcccacatcttcctgtcttcttctgagccctccaaactgttccaacctctgcctgttacccagttccaaagtcatttccatattttgggtatctttacagcagcacctcactctactggtaccaatttactgtattagtccattttcatactgctatgaagaaatacccaagactgggtaatttataaagaaaacgaggtttaatgtattcacagttccacatggctgaggaggcctcacaatcatagcagagggtgaaggaggagcaaaggcaagtcttatgtggtgagcaggcaagagagcttgtacagggaaactcccctttataaaaccatcagatctcatgagacttattcattatcacaagaacagcacaggaatgacccgccccatgatccaattacctctcaccaggtcccttccccgacatatgggaattatgggagctacaattcaagatgacatttgggtggggacacaaccaaaccatatcagtcgtcataactgggggtgatggtggtggtactggtatctcctgggtatagtcggaggatgccactaaacatcccacaattcataggagagctccctaaaacaaagaattatctggcctgaatgtcagtagtgccacagttgagaaaccttgcaatggattaagcaaaaataaaagcgcaaacctaggtgtagagaagccaagaagggactttatgaaggaaaacaaaaagaggatattcatttgttgtgcactgcgcaatacaaaatcctccactggctgggcatggtgatgcacgcctgtaatcccagcactttgggaggtagaggcgggtggatcacctgaggtcaggagttcgagaccagcctcactaatatggtaaaacccccatctctactaaaaatacaaaaaattagccaggcgtggtggcgggtgcctgtaatcccagctactcaggaggctgaggcaggagaatcgattgaagccaggaggcggaggttgcagtgagctgagatggcgccactgcactccagcctgggtggcagagcaagactctgttaaaaaaaaaaaaaaccctccactaactttcctttctttggtataatctgtatttctcagctggagttgattttgctccctaagggacatttggcaatgtctggagacaattttagttgtccctactagggggcagcattgctactggcatctactgggtagaagtcaaggataaacaacttaaaatgcacagcacagtaacttaaaacaatggatttttcagtccagaacatacagtgttgaggtcaagaaactgattgcattgattgaccagtgaagtttttgtgtaagtaaactgtgtttcagaaattcaaagaaatacttagttctacatacaaattgggacagatggaaagcaaagctctgaatatacacaggactcaaagtacgaggattcagctgacctcagagttgtgcataagattcttagcatggtgactcacattcagtaggcattcaacaaatattaggtcccttccaccttccctctcccatcacctactatatataatacttgttaactattctgggtgttgctcaagctgttttcccccatttggaatgccctttctctttcctctctgccaagacaaatcacctttatctttctgggtccagccaaagtgccatatcttccctaagttcctatctactctccttcattccaaaacttctgcagttacagttcttgttatcaaagaataatgttgacatttacactatctgcataggaatctagtaggcaataaaggtagaccgttttaaatcagtgaagaaagaaaaatctattccaaaccaaataagtaaaataaataaatgaaaaatacataatatatagcaggacaattgatcaaccaaaaaactcttactgttagaaaataattcccacaagattattgcttttataaaaaacaaaagaacatcaagtttatagagagaaataatttctgatatcaatgtggaaaataattttaaaacagtaaagcaaccacagaaaattaaaagtaaatatgaataggtttgataaagtaaaaatgaaaatcttcttaatgttgaaaatatcatcaaaggcaaaggaaacaccagaaaaataatttaaaatatataatatgatcatagttatttatattttatatatggagctttttacaaagaaaaagtaaaagatgaataaatatgggctgaaatgtaaaaggcaactcactagacaagtgaacaacatatatattaaaaagtgcttgacttctttataatcaaaggaattaaaattaaaccaatatgtaacttttctctaacaaattgggttaaggttctttttaagggtctaatgctacaaaggatgcagggaaataaacactgataaattaaaattcgatttaattctattctgtgaagggacagttgagattatacgtataatctgtatatgtttaacagcctttggctcagtaatattacttccagacatttatcccaaagagataatcagatatacataccagtatttataaacaaggctatttatcatagtgttaattaacataattttttttaatcctcaaggtccaatgatatgatactagttaaattgtagcatatctgttcttgatttggaatagcagaaatcatgttcttaacaaatattttaaaatataaggaaaagcagtttataaaatgatctcgattgtttttagaaaactacattggtccatatatctatataaacaaaagcaaatgaaatggacacacatagacacacacactaaccatggttttctacattatgggattatagatggttttgtttttgagatggagtctcactctgtcgcccaggctggagtgcagtggcgtgatctcagctcactgcaacctccacctcccaggttcaagcaattctcctacctcagcctctccaggggctgggattacaggtgcacaccaccacaccaggcaaatgtttgtatttttagtagagacggggtttcaccatgttggccaggctgacctcaaactcctgacctcaagtgatccacccacctcggcctcccaaagtgttggaattatgggcgttagccaccgcgcctggccactagatggttttaatatttaccttattttctaaaatttctataaaacaatgttacttttattataataaaaacgtcaagcataacttttgaataactgcttcaaaagtaacttaatgaataattaaatgactgcagaaattaattcaacaggcattgtatctgagggtatttaaaatacaagcatctcttgtctttcccccacttaaatgtaaatgccactaataggagatatcttttttctaacactgcatcttttttttaacttttaagttcagggttacaagtgccaggtttgttacatgggtaaacttgtgtcatgggagtttgttgtacagattatttcatcacccaggtattaggcctagtacctattagttatttgtcttgatcctctccctcctcccacacgccaccctccaaaaagccccagtatgtgttgttcccctctgtgtgtccatgctaacactgcatcttaagtgctaaaaacaatgcctcgaacatagtaggagcacagtaaatagctgaatgaaaataagtacattattttattttcattgagcaaaagtaaacttttctatttctgttacttgttttgtctgttgacaattgttggcctacacctcaccttataataagaaataatatatgttgtttgtgtcttttacacaaggcacccacataaaagggacacttttatcttattttacagatgaggagactaatgctcagagaggttgcataactttcccacattcaaaaagtgagtaagtagagcttgctatctctgtgctgaaaattatagattcaatgaagaagcgacctagagtacacagaaatataggagagatgagaaagacattattaggcaaagcacacagacatctcagtttacagcaaaataagaaccctgtaaaggtatttttcacactatgcaatgtttttaccactcttcttctcgggccttaagcgtctctgcagctttctagcactagagaaacccgcatggtaaactgaaagcttaaaatgagagaattacaatcactgagtaatcagacttttcacaagtcctttttaaaatattagtctagccgggcgcagtggctcacgcctgtaatcccagcactttgggaggccaaggcgggtagatcacgaggtcaggagttcaagaccagcctggccaagaaggtgaaacccggtatctactaaaaaatacaacaaattaaccaggtgcagtggcaggcgcccgtaatcccagctactcgggaggctgaggcaggagaatcgattgaactcggagggcagaggttgcagtgagctgagatcgtgccactacactccagcctgacgacagagtgagactccgtctcaaaaaaaaataaaataaaataaaataaaatattagtctaaatggtttggttggatatctgctcacgtggcatttagtaaactacagaaccatgacaacaataaaagaaaagtaagaaatgatctgaagaaagactgcagtgaagcttcatactgctggctgggggaagggatacgaatatttggggcatgcaagataagcaaaagaaactgccagtgtaacaagtcataaatccaggctcaatttataacttctaaaatctgaatttttctgggaataaaattatgaagtgccacattagccatatttagggtggcagacactggtggtttacctacccaacagctacgcccaccacctccctcttatgtcccttcctacttgctggcataacccacttcctgttatagaggttacaaaagccagacattcactttcctagcctgccttacagataaagcatgggtatgtgacaggaaagtggcctacggcactgacaggaaagtctgcttggcagttttagagaaagatctctctcccttacaaacagagacatgtgaggtccttcctgcttttgtacagttgtgtgaagatatgaggctgtgacagtcatttttagacaatgtagaaataaatttgaagaagaatactagcatgctaagtatgaccacatggagatttggaaagcagctggatcacataactgtgctgctgaattaaactctatgtggcagctatggaggtgtgcagctcatctccattcaagaaaaagcttgctgatcagctgtgtggagtgcagttagctgacagcccccaactgcagacaatccttggcagcatctgagccaaggctagccttttccaggaagtctcaaccaatagctgagcacagtgagacactggggcccagtcatttctgcccaacactggactcttctatgggccatatttgcagcagagctccccgttaggctcaccctgatttctcagagcctcagtgcagttttaggctcttcctacccagtcctcctctctttaccttctactttcacaggtatcagatctgagctgcagtcagaaggatttccctgacctcttgatacttttcctctttatctttcataggtgttacccccagtaaatattggacccaagcaatatacccaggaatcccctatctatgaactttgtattatataaagcaacagatatctttattgcttaagtcattattagttattatattactggcagcccaaagtatcctaactgataaattggaaaaatagccataaaataccttgtgtggaggctgtgaattttccatcattgagaagagggtccaatgaggtatactttatttggatgagagttgactataataagcaaattaaactcttctcttggatgtttatttaatggggacactgaaaacacaggattctatagggaattactataattttataaaaattggaagcatatcaaacaagcccagcttttgaacagtcagcagcaattagaggaagaagtgagaaacaagcagagtagaaaacttgagctgcagtcatgaagagacccaatatcaaggtcatctgatccaatagcgttaacagcattcacacttggctgcacctggaatacatcactggctctgacagatttgaaatgtagccaaccggagaaattcttgcaatcaacagcctagaggggctcagggtgaacaattctacctaatggagatatatagcccaaagcaataggaatcttctcatgaacacaaggaaaattttttaaaaaaccttttcatatagaagaggaatatggagacaggaattgatgggccatgtttgttttcccacctaagcctgaaaatccaattaaaaaaatagaagagcaagtatttctacaagaatattgtgaaagtcagcaaaaacatttctctccctccctcctcctttcctgcaacccaagtgtccttccctttaaaaaaaaaaaaaggtaattcagaatttcttggtgtattgattggataaaaatctataatgaaaagatgaaaggaggactggtcttctctccttatgctgactcttccatttcactttccaattgctgctaaagctgttcagtgccattcaaattcagaaaactaccacaatcttcaattctgtgtgctcctcacacagcacatagacaataccaaaagcccgtcattgttttcacatttcatgtaaatgtcagtcccctcttcagataccctctcctactgcaaaattctgtttctgttttcttctagctcttccaatggggtaaaatgtctgcgatgatgtttacccagcttaaataaagtctatccaatcttcctaagcttgcaatatgtggcgaacttttggcagtaagtataccaatgtgttctggggtcctaattaaaatttcaattggaacccatttctcatattcagcaaaatccctctgaagtccaaactaactgactttaggcttatgccctgtgagaacctatatgccattttacataaatgttttaattttctctgcaatcaataaatgtggctttgtcatatcccttcccaggcatttctgtttttgttctctttgtaggcccttcctgtaacacacacgctattttatagtgccttcccatcaagtaccatatgacatttcattctaatttaactctgctgtctcacagataagagaatgttaaatgatggtaactaaaggggataagtgttttctacttctggaaaagggtctcctccttacccacccttctacaacacatacacaagtgtgcaacacatacacatatattacacatgcatacactgtgtgtccagtttagctgaaaacacatagcctgccttttacctcccccaaacctcattctgtcattcagagctcggaacagcatgcacagtatgcagagtaagctgaacttactgttcatgtagataagggaaaaagatctccccctttccttttcagaagataccagttgctgcctccagattcaagcataagataatagttaagggcatagtctccggagtcagaaagacctgagcctgagtctctgtttggccagctgcagtcagttacgtgagtttgggcaagttatataaaggtcctaagtcttggtttactcagctctaaaataaggacggtgattttaggctgggcacagtggctcacgcctgtaatcccagcactttgggaggcagaggcgggcagatcacgaggtcagcagatcgagaccatcctggctaacacggtgaaaccccgtctctactaaaaaatacaaaaaattagcccggcgtggtggcgggtgcctgtaatcccagctactcgggaggctgaggcaggagaatggcgtgaacctgggaggcggagcttgcagtgagccgagatcgcaccactgcactccagcctgggcgatagagcgagactctgtctcaaaaaaaataaaaataaaggccctaagtcttggtttactcagctctaaaatatggatggtgattttaacctgtgcttcatgaagacttgatgatatacatataaagcaaccagtataaaaagtattatactcaataggttttttaaaacaaaaaatggtaagataatggtacaggccaattccacctagttgtcactcacaaattataaatgttaatgtctcataaataaaagaatttcaaaaacatgatccttttgttttcggagttgttcccatggggaggacacttatttggtccatctgtggaagatgtatgttttccacttatttggtccatctgtggaagatgtatgttttcgacctctgctgttctctgcctgtctgcttcattctcctccctctacaaagtgccttttgctgtttctgcatgcacgtgatggaatatggctgattccatagctccctgatctacattacttctgtcaatgctatcaatatagattgaggtagaatgtctggctccaggtttatatttctttatgagaggaactgattgctccactttggatcaggtatctactcatggtccaatcaagtgttatgggtgagagggctagtggtgacagagccctctagcacaaccatagctgctaggacctcaaccctatgcttgagggaaggtaatcttcagaaaaaggggactgtagaagctatagtattacattggttttcttatgaagaaagctcatatatatttattattttatgaatccagttatcacttctagttgtcatgcagagactgttaaagttcttttttagcatttctttgaaatatgaggattttcatgctatctggataatcaattcattggtatatacattattatttattttatcgcacattttatctaccccattctttttggaaacttttatacaatcatctgacaagcaatagctacttctaatgaattttaataaccattttccaagaaggatagcactcacaatactatgcatatcatcattatctaccaagcctattctttataaaatctgaagctgttcaattaataaactttcatgtctaaaataagacaaattataccacttaaatttatttgcccccaaaacacttttacatgaaactcagtttcactatcatcattatcatatttagatatttacattttagcaataaaaatacatgttgacttttacacttacgatttagataagatgaagatatttcttggcactatttatttttcatatcatcctaaaccacaaagaaattgatttaggataactctctcaaatatgacaaagttttttttttcttatttactgcatgtctaattcattatcatttcttttcatttatcattgatatggtatcttaatatatcagttttctatgttgagatttaagtagttcatatagaaaactaaataaatattaatcatattggctgcttcagaaaatcttagaatacaatattgaatatgccagaaaatataaatattaatattgtacaaagtattacttgagggtcaaagaacttagaagagaaggaaaataaattattattatgcagttaaatttgtactaaaccattgggggaaggatgtttcaaagacaaaatttgctggttcagaggaaatgtttcatggaatttttttgccagatatgttttttgctctcatctagatggctcctattttttgagagatattcgatcataccaggcgtcatggtagggctaggagttgaaaggtttatatagatctgtcaaccccaacactaaaccctaaagtttcctaattcaaccgtagttttgtgaagagaaaagaagacatggctcagaccactgggttttggccagggccaatgatctccacttactggagtcaaggctcattatttattcagaaacctaattctgtaggctgtcatggcaaaccaagatgcttcttgagccctcagttagacctacatgagaaatttgtgctcttgtgaaaaacctagtagcaaagggccgggcgctgtggctcacgcctgtaatcctagcactttgggaggcagaggtgggcggatcacgaggtcaggagttcgagacaatcctggccaacatggtgaaaccctgtctctactaaaaatacaaaattagccgggtacggtggcacacacctgcagtcccagctactcaggaggctgacgcaggagaatcacttgtacctaggaggcggaggttgcagtgatctgagatcctgcctctgcactccagcctgtgtgataaagcaagactccatctcaaaaaaaaaaaaaaagaaagaaagaaaaacctagtagcaaagacacagcaactagctgggcttcacagactagccaaaagttcttcatcatagaagttgccttacatagcagtagcaaaatgagaaaaggtgcatgcacaaagccctatgtttagagtggtgacaaaacctctgaagtaaggggtctccggcaagtatacacatcccagtctggcacctatctcccaattcatctgactctggagtgtgcaaagaaagcattcgttattttgccaggaatcccaccatttgaccaccttgtacctcagtagatcaggggcctcctgggatgtgaccaacaaataactaaccattgtgacactggtgtctaaccatgttcctgacactattgataagagaaatactataaagcagggctaggtctcttttctgcaaccgaggtagtgaaaagctttccagctttgaaagcagaaagatctgggttctacagaagttccatcatgttatttataattttttttctttttaaataacaaaacatacataaaacatttaacaaataacaggtgtatatatatatatatatatatatgtaaatttacagaatgttcatactttgtcatatttgttttagagtttattttgttaagaaattaaagactatagagatttaaaattctatgttatcctatttccctcctttgtactccagtggtaactactctcctgaagttggtatgcatccttcccatgtgtatttttatttttactatgtagtattgttattcatgttctcaattttatataaatggtgtcatgccatatgaatctttttgaaaatcttctttgctcaataggtagtgaaatttatcaaagctgatttattaatatgtagatctagttcatccatttaaatttgaatagcatgccattctatggctatttgagtatccattactctatacatagacatgtagattatttgtagtttgggactcttacaataatgccgtagtgaacatggttagataagttcccttgtgcatgtgtgtaggaatctctcaaaggcatataaaggattgattttcaagtgaaatagaccaatatgaccaacccggtcatttacagtatatgtttgttctaattgattggtacccctgagagcagttgttaaatattttgaatatcaccccttgatacatacctagaagtatcactgctgggtcatatagaatgcacattttcatctttactagatatattgcctgtagctctttaaagcggttcaactaatttacactccaagcagtagtttaatatgtacattcctatttccctacaagtggaattgttaggctaactttcactggtctgatgagtgtgaaatggtattttgtaggattttttttgttttttttttttctcccaagatggagtcttgctctgtcgcccaggcttgagtgcagtggcatgatctaggctcactgcaacctccgcctcccgagtttaagcaattctcctgcctcagcctcttgaatagctgggattacaggcgcgaaccaccacaccccgctaatttttgtatttttagtagagacggagtttcgccatgttggccaggctggcctcaaactggctggtctcaaacttctgacctcatgatccacccacctcagcctcccaaagtgctgggattacaggcatgagccactgcacctggcccatattttgtagttttaatttgcagtttcctaattaccagtcaggtgaaacatcagctgtttatcagccattcagaactattatcttgtaaattgcctatccatagcctttactccattttctatagggctgtctacctttttcaagttgatttctaagtgttctgtatttcttctccatattagtcctttgtcaattatatggattgctaacatctttttccggtttttggactatctttcactttctttgttgtgcctctcgatctaaagaatgccaccatttgttagctctatgaatttggataaaccatttcaactctcaacatcttaatttattcatttataaaataaaaccaatagtgccttacttacaatattgtggtgaataaaaataatgacataataaatgtacaggaatgagcaatatgcaataaataagtagaagttttcttcttgcggctctaccctcaaacagaaggggaaacaggggcacactactatgcaaatatattcactgagctatggtatgtcaaaaaagacatcctatggatgcttgaacagaaggattaatcaactggattatattagtcactcaataaacattaatatttattgaacccttcctatgtaccaagcatagaaatagagtgtgatgcaaaacagataaatgcttgttgaagtgggaaagagggagacaacaagaaacaaattattatttgctacaacatcaggatgaagaaagttaaaagttatgtggtgattacaaaatgattgaggggtacaatttcatatcagatggtcagaaaaatcccatcatggaggcaactgaagtagaaacccagaagaactgaggaaaggatcatgtgaaggaagcatatgcaaaggccctgagaccctggcatacttgtcagtcaaggagaaggaggacagtgtagtggaagggaatagcaagagggtgcaggacagggatccagggacaagataatgaccttggagtgcacgataaggattctagattttattctaagtgcaatggaatatccctggagggccctgagcagaggagtagcatgttataatttatgttttaaaaggatccatccaactacaagatggataaaaggctgcagaagtgtaggagagtgagtatgctgaccatggaaagctgcctttcttgcgtggaagattctaaagccattcattctggtcatttcccccaggactcaaaaataagcaactctgaactgaaatctcaactgcagcaactggcattatttctatttactcttattggacaatccatatttaattcagaacctggaaaaacataagaaatactggcaaaaacaaatgacaaaacaattgtgctgaacttgtttacctctcatttgcactggctactttgtgcatttttctttgacttaaagaaatcaaggcgtatttaaaatggttactgcctgtagattttttttaagtgtcaaatgacttgtgtacaagcagtgatttccccatgatttttttctggggggaggatgggggtgggtatcattacctagtgacatggagaggtcatacctaaccttccctctcaagaaatgctggctatctgatcatgaatttttcccaattctttcccactctccaaggtgttctaattgatttttctccctgctgtttagaatctaaggatatttaattaatgggtttcttttacacaaatagaaaaactcagcatgaccaaagtcagaatggtcaacagctaagctcttccctgccttccagctgtaacaccttattaagactgatttccccagccagcctgccaatccacaggtacttcacattgtgttttaaaagtttctgcttctgcattgaaatcaccagtattatttcttaagaaattattcctacagcaggtcttcccaaatattgattgaaaatgaaccacctggagatcttgttaaaatgcagatttgaactctggatctgggatagggtacaggattacgcgtttcccagatgatgctgatgttggtgatctgagggtcacacttatgtagccaggtcctcagctgaaggcaactacagctttaaacattagtaaaatatatacaggtgctcctcaacttatgatgagtttatcttccaaaaagcctatcataggttgaaaatatcgttaagtcaaaaatacataaagagtttgtccataggtagtattttagccctttcccctccctccctcctctcttgtagtactcagtgtctattgttcctatctttacgtctaagtgcatacaatgcttatctcccacttataagtgagaacatgtggtatttggttttctgtgtctgccttaattagcctaggataatggcctccagctgcatccatgttgctgcaatgaacatgatttcactcttttttatgactatatggtattccatggtggatatgagccacattttctttgtccaatccactgttgatgagcacttagattgattccatgtctttgctattatgaacagtgctgtgatgaacataagtgcatgtgtctttttggtaggaagattttcctttgggtataggcccaataatgggactgctgggtcaaatggtagttctgttttaagtcatggtttttctctgagcatcattatttggtgacaaggagagatcaagcctaaactttcaagttgaaaatttgaaaatttatctaactatggtatacataataataatttacaatcttgcattaatagcctaaatagttatttcccctatcatttaagatctttttagacaagggagaatctggcatttgtctttggagggatttctttgaggtcaatagctcacaatgctgaaaagtgttcaatcctcagcactggttctcaaggtctactcccagaaccagcagcattagaatcacctggaaacttgttaaaattccaaatttcaggccccacctaagacctactgaatcagaaatactgtttgtagcacccagatatctgcatctgaacaaacccatcaaacaattctgaattttgagaaccactgctctataagaccagttgctttattttcattactaaataaaacacattccgctgggcacagtggctcacgcctgtaatcccaacaccttgggagaccaaggcgggtggatcacgaggtcaggagatcgagaccatcctggctaacatggtgaaaccatgtctctactaaaaatacaaaaacttagccaggcgtggtggcgggcacctataatcccagctacttgggaggctgaggcaggagaatcacttgaacccgggaggcggaggttgcagcgagccaagatcataccactgcactccagcctaggtgacagagtgagactccgtctctaaataaataaatacatacatacatacatacataaaaccattcataagattttcttaaattgactgtataagactgatgtttaaaaagccccacaacccccataaattctatctgcatagtgtttggcacatataaatgaaataataaatacaaatctggcataagggggaagattagtataggtttccccacaatttacaatatatcctctttcttcactaatgtagctgttagctattcattgcataaagaaggaatcccaaaatgtgacacagacattaacatttaaaaatttaggcaatttatagcaagtagtaaactctcaggaggccagtttgatattgctttgagggccacttttttttttttttttttttagagactagtaattgtttcttttttttttttatactttaagttttagggtacatgtgcacattgtgcaggttagttacatatgtatacatgtgccatgctggtgcgctgcacccaccaactcgtcatctagcattaggtatatctcccaatgctatccctcccccctccccccaccccacaacagtccctcaatttcttatacaaagaatatctaggcattgttcttttctcatttcaaagtttattcctcctcggaagaatccatttgaaccatttcttctgtataattgactatttatatgcaggtattactggcgaactttaccctcttgagggccactaaccatgcctgggttacttttatgataaaatgtcactaggagatgagaatctaactatggaaaaactccaggctggttttcttaagacttccatgggaaaatgtcagcaggtccatgcatgggcctacttcagtcctgggctccaccaaaaaaaaattactcatcacaagtaattggtaaattctaataaatttctaagtgagagagttcccctgagtttccgtcaccacatttagtgctggaagtggtcttggaaatagctagaaatagtttcatgtcatcatttagaattagaatctgtaatattttaacatcaaatgcacctcataaatcacaaatatccctacactgcatttttatctagacttttttgaaaagttacattttatgtcctaacttttacaaccttacattatgagttttcaacatttttatctgctatatatatactcattaaaaagaatttaatatcctgcgcattgacctattaaatatcctaacgaagagagtaaattaactgcttttgtaagaacatgaagaatattaataaacaataagcaaaattgctagtaaatttgcaatggccaactttatatgtcaacttggctgagccatggtgctcagatatttgatcaaacattattctggatgtttctgtgaaggcatttttttggaagagagtaacatttcttttttgagattgtattagtccattttcatactgctataaagaactgcccaagactgggtaatttacaaaggaaagaggtttaattgactcacagttcagcatggctggggaggcctcaggaagcttacaatcatggcagaaggtgaaggggaagcaaggcacctttttcacaaggcggcaggaaggagaagtactgagtgaagggaaaagagccccttaaagaccatctgatcttgtgagaactcactatcacaagaacagcatggaagaaactgcccccgtgatccaattacctccacttgatctctcccttgacatgtggggatcatagggattataattcaagctgagattggggtggggacacaaagcctaatcatatcagagattaacatttgaattggtgaattttgagtaaaacagattaccctccataatgtatgtgggtctcatccaactggttgaagactttacgacaacaaagactgacctccctcaagcaagaaggaattcagccaggacacttcctggggattcaaactgcaactcctccctaagtctccagcctgcctgcttacctcatcagattctggattcaccaagcacccacaatcatgcgagccaactcatcaaaataaatcttgctcttgcttactctctctctgtctctgcgccccccatctctacacacacacacacaaacacacacacacactaaaacgcaaccatatcctgttggttctgtttctctggagaaccctgactaataaaaaactgtgaaggataattttaaaaggtaaaattatatctctcatacaaatataaaatgatcatttgtcagaaagttttcccaggaaactaatgtatctcacagaattgctgtagtctacttagcatgcagtgatgttctcaataaatacacactattaatatattactccaagcagattcatttcaagacatagataatatttagggcccaatctcctcattctgaaactttgttccaagtctgtcttttggacatttttttcttttccttattaaaatctggacatactatgaaattctttcacaattagatgataatatagaaaagttttcagtgataatagaggaggcagcattcaagtgaaaaaaaaaaagactttaaagaaacaaagtgctagtgttgaaatttcaaacatcaactctggagttgtgaaggtgtttctaggttaagaaattcttcctgagatccccaaaaccacatcccagaatatgtcctcctactcctagaggtaaggtgaggcctgtgggttctacatagtatttgtgtatacacagacacatgcacacatacgtgcgtgtgtatatacttctacataaaagatagcagcaagaatttatatgtacaaccttaccttttcttttggcacttaataaaaaccagtctactgagtttacctcacagaatccccaaagagaaaacattccctgtaaagcagccattcctgttgtgcttatttactgatccatgggcaatgctcctcccacagagaatttcttcctggaaaaagaaatctgcttttaaaaataaggtagacttttatctgcctggcatatcctcagcatggaccaccctgaagacagggcgataaacgcactaaatgaatctgtaaggagttcccttcttctccttcagtgtggtggtacttaattttttggtttcatacctattgctgccgtgaaaatggtcccccttcttccttgacactaaaagaaatgcccagcagttcattcaagactttgccccagctacagaagttgggaaagtggcattttatcctcttgatatatgttgttttaactcttagtgaaataaatggtttctatattacacatcattattcatatactgaaacgagatcttttctgaaacatctgaaaaagatttgcaatttggatgatcccttatcattttgatttttcttcagctatgtttaggagttccatgtattaaaaattcataaatattcagcatttaggctgcaaggagagcaaagtgtccctcaaaagttcaaattagagaaacggtgctcagtttccacaccaagcagcagtatcaagagctgagtattcataaaaaagtaactgtctctaaaactcataagcattcatattctcagaaaagtttgggctatgggctttaattttgtgttccttaaacttggagtagagtatatactggtctctgtgtacaacttaggtcagattcctaataaaatttcaagtccttccaggattgcatcacagaagagggactgggaaagaatcatcaaagaattcagaaacaagaatgacaaagtgaaaatagggttgcaaaataatatctttgcagagaaacaatttgaaaacttaggaataatttaataatcaacttcaattgctgaatatgatgataatcaagtaaggaataacgactccatttgaaatgtggatcaagctaaagtagcagtattcaactgcatactaatgaatcaaggtggacataaaagggattttccctccaaaataaagatgataaaaccttaacatgtactgtagaagaatgacaaaattttttctattgattcattgacacattcatccagcaaatctgcccggctacctgttgttacctctttctactcatctcctccctccctttccattgcttactctgactcctgtcttactgaccttttctgtcttcaacctcttgacatatttctgcttcagagctttgcaattgctgttcccgctgcctgaaaatatcttcctgcaggaagataactgggtcattccctctcctccctcagacatctgctctaaaaccaacctctcagtgaagccttccctggccaccctctcaacagcttccattacatttccctgatttatctctcttccttagcacataatcactacctaaaatcagtaggtaattttaggtaatacctaatttaggtatacataattttagtagataatacctaaaactgagtagtattccattgtatgaatgttctaaggattttgtagccactcatctcgtgaaaaagacctggattgtttctagtttttgctatcacaaacagccgctaagaataatcctaaacagcttttattgtgaacataaatgttcatttatctagagtaagtacctaaaagggagattgctaagtcatatgtaagtgtatgttttcccaagtggtggcggtggtaccaattttttttttttttttcattccaccagcaatgagtaggactactcatctttggatcctggccagcactcagtatggtcaccattttttattatggccattctaatgggtgtgtagtggtatctcaccatggtttgaacctgcatttctcaatggatgattttgaccaccttctcatgcgaacttttgttatccatatatcctcattgatgaagtatctattcaagactttgcccattaatttgtgtgtggtttctttagctcaatattttttagccttttatgaaatatttaaaaacgtagaaaaagttgcaaaaatgggacatagagttctataaatactttgaccagcttgccttattggtgacatcttaaataactatagtacaatatcaaaaccaggaaattaacactagtagaatactgttagctaaactatcgaccttattcagttttcaccagtttttatgagcaatcatttgtgtgtatgcgtagttttaggcagtttgatcccatgtataggttcgtgtcactgttgacaaatcaagatacagactggtccatctcccagatgaaactccctcatgctactgctttctaatctcaccaatcccccaccctctgttcttgtcctctggtaaccactaatctgttcttcaacttaatattttgtcattttcagaatgtaatataaatggaaacatacattatgcaacctttgagactgtcttttttttttctaaaaatattgccttagagattcatcgaagttgttacatgtatcaatactttgtttctttttattgctgagtagtattccatggtatggatgtgccagagtttgtttcaccaatcacccattgaaaaacatttgggttgtttacagttcggggatattacaaatgaagctgctatgaacattcatgtactggtttttgtgtgaacataagttgtcatctctctgggagaaatgccgaggagagcaactgctgatttgtgtggtaaatgtgtgttttgttttacaagaaactgcaaaaatgttttccagagtgcctgaactattttcgatttcccattgcaatgtaagagaggtcccatttctctgtacccttgctatcatttggttttatcactttttttattttagccattttaatagatgtatatattgtggtagttttaatttgcatttctctaatggtgaatgatgttgaatatcttttcacatacttttttggccatctgtatccccttttcttctgaaatacctgttcatgtattttgcatatattccaattgaactattttttagagttgaattttgagtattcttaatatgttttagctgccagttctttattgtgcatatgactttcaaatgcaacctcccagtctgtggcttgtcttctcgtcctcttaacaggatccctaacaatacaaatgtttttaaatttgattaagtccaatttatcaactttttcttttatgaattatacagttgttgtctctcaaatctcttcacttagccctaagtcctgaagatgttctcctatgttttcttttaagagttttatagtttcgcatttaaacccctgaaacattttaaatttatttttgtataagttgtgaagtttacatcaaggcttatattttcttaacctatagctatccaattgcttcagcaccatttgttaaaaagactgtctctcctccattgaaaaggatttttgcacttttgtacaaaagtacagttggctgtacaactgtggatctatttatagattctatattcaattccactgatctatgtgtacatccttccactaataccatactgtcttgcttactgtagctatataataagatttaatttcttctttttcaaaactaatttagctagtctggctccttcgcctttcgatattaattttaaaataagattatctatctacaaaaaaactttttctgggagtttgctagtaattgtgttcaatctagatttggaaagaattgatatatttattatcttgggtcttctgaatccatgaacactctatggttgttcatttatttagatcttctttgatttcattcatgaattttttttttaattttattttaagttcaggatacatgtgcaggaagtgcaggtttgttacacaggtaaatcttataattttcagcgctcagtctgcacgtttggttagattaatacctactaagtatttcatattttgggggctatcataaattatatgcattttaaattttttcttccataggtttatttctagcatacagaaatgtaattaatttttgcttgttgatcttatatctggcaacctcactgggcttgccttctaagagttttgcaaattttaaaattgttttcttaatgttgagttattataattatttaattattctgaatagaaataatttgttaggtatgtgatttgtaaatatttttccagactttagcttgccttttcattctcttaacaatgtctttcacagaggaacagtctttaattttgatgaagtccactctgttaatttttttcttcaattgttcatacttttggtgtttggtctatgaactctttgcctaatcccacattatgaaaatgtttctcctatactttcttctaaaagttttgtaattttccattttacatttaagtctatggttttcgttttttttttttttttttttttttttagaaggagtttgagtttcgctcttgttcccctccaggctggagtgcaatggtgtgatctcggctcattgcaacctccacctcccgggttcaagtgattctcctgccctagccaagtagctaggattacaggcatgcgccaccacgtccggctaattttgtatttaatagagacagggtttccccatgttggtcaggctggtctcgaactcccgacctcaggtgatttgcccaccttggcctcccaaagtgctgggattagaggcacgagccacaaggcctggcagtctatgctccattttaagttaattttattagatgtgaggtttatttcaaggtttatttttttgcatatggatgtccaatagtttcaataccatttgttaaaaaggatgttttctccattgaactatttttgcacctctgtcaaaaatcaattggccatatttgtatgggtccatttctggactctctattctattgcattgatctattcatctgtttttgaggctaaatgacattgccccgattaccgtcgttttttcatatgtctaaaaaatgggtagtatatttgcttcacctttttactttccttcagatttattttagatattatagtaactttgcctttccataaaaattttaaaatccgtttgtctatatctactctgattggcagcttctaagaagccccccagtgtccccgcctcctggtgttcacagccttgtgtaatttctccccaggtaacttgctcctcaaaacagaattcagcaatgttgagggaatgtcacttctattattaagtttaaaaagaatctgtctgctgtcttgacaacagactctctctcttgctagctttgatgacacgaattggcatgttggggagtcccacatgttagagaaatgagaaaggcctctaggcaacaaccatataggaattgaggcccttagtcaaatagcccacatataactgaatcttgttaataagtacatgagcttgggagtggatccttttccagtcaagagttaagattagcccagcctacatcttgattgcagcctgtcagaaatgtataataggaatccatgtccagattcctgacttacagaaattgtgagataataaatgcatattgttttcagtcacaacattttggggtaattggatatacagcagtaaaaaactaacatatctacaaaaattcctgctaagattttgattgaaattgtgttaaatatatagatcaacttggggaaaattgacatctttactatgttgagccctcaaatccatgaacacagagtctcttcatttatttagatcttctttgatttcattgatcagcattttgttttcaacatacatatcttttaaatgatttgttagatttatacatacatatttcattttttggagctattaaaaatgatatttttcacaaatttcggtttccaattatttattgctaagcaggatataaaaatatgattgacttttttgtgttttgacctagtagcctatgaccacatcaagctcatatattagttctaggaagtctttatagattccccggactattctccataaacagtgacgtcattttggaatagagacagttgtatttcttctctttagatttatataccttttatttctttttatttccttatacactacccagtatttccagtacaatattgaataggagtagtgagagtggacatatttgtcttattcctgatcctatatcacattgagtacactcccttctatttctagtttgctgagtgttgttctcatgaatggatgttgaattttgtcaaatgctttttctatgtcaattgatataactgtgctttttagatttttagattgttaatatgatggaattcactgattaattttcaaatgttaagtcttgcattcctgagacacagcccttttggttgtggtgtattattccctttatacattgttggattttatttgttaatatttttttgaggatttttggatctctggtcatgggggtattaatatatacttttattttttcatttgtactgactttgtatggttttaatattaaggtaatgctagcctcattaaatctattttagaaggaagtattctcttctctgcaattttctgagaggcactatgtacaattggtgctacttcttccttaaatgtttggtaaagtttaccagtgaaaccatcttggcctatagattttctttttggaaaaatttaactatgacttcaatctctttaatgattatgggactatcaggttatttatttcatcttcagcaaacattaatatgcaacttgtaagttttgagaaattctccatttcatgtaaattatgtttgtgtaattgttcatagtattcccttattacccctttaatgtatgtagagtgtgcagtgaaatctcttctttcattcctggatattggtgatatgtgtctttatttcttattaagtcttactgtagtttcaatcaattttagtcatcttttcacaataacaagtatttcattaattttctttattttttgctttcaattttattgattcttcctcttatctttgttcttctttccatctagttgttttgggtttattttgctctttcttttctagtttcataagacggaagcttaggttactgatttttggaacttccctcttctctaatataagcatttaatgctgcaaatttccctgtaagtactactttacctaaatgtcacaaattagatcggttgtattttcatctttgttgagttcaaaatattttctaacttctgttgagacttcctctttgactcatgaagtatttaggagtatgctctttaaattccacatgactggagatttttactcttacctttctgttatttatgtctaacttaattcttttattgttagagaataaattgacataccttttatgatttcaggcctaaaattttgttaagttttgttttatgtcctatgatatattctatcttgataaatgatccatgtacatttgggaagaacgtgcattctcctgttgattagaggagtgctctataaatgtcaattatacactattaatttatgatgtttcacattctcctataactttgttgattttctgtctgagttctatcaattattgagagaagattattgaagtctccaactgtaattgtggtttgttttcaatttttccttcttttttttattcctctgctccttcttttctgtcttcttttaggttgttttaactttttagtgttccattttaatttctctactttttactgtgtattctttttttttttttttttttttttttttttttttttttttgagccggagtctcaccttgttgcccaggctggagagcagtggtgcgatctcagctcactacaacctccgcctcccaggttcaagcgattctcctgcctcagcctcccgagtagctgggattacaggcatctgccaccacaaccggctaatttcttgtatttttagtagagacagggtttcaccatgttggtcaggctggtcttgaactcctgacctcaggtgacccacctgcctcgtcttcccaaagtgctgggattacaagcgtgagccactgcgcccagcccgtatattcttatataatttttgagtggttgctataggaattataacatttatactaaacttattattatctacatagaatcaacgttctaccactacaagtggtctgtagaaagcttttcaccatataagtccctttactctgtttcctttatgttgtaactctcttatgtataacactgacaaatattaaaaacccatcaagcattatagtttttgctttcatttatcaaaaatatttaagtaatgcaataaaataatgagagccaatgatactgacttggatatttgcaatttctctttcttttcgctcctaatgttgcaagtttctttctggtattattttccttctttctgaacatcttcccttagcaattcttccagaggtagttctgctggcaaaaaattctctttatacttcatctgagattgccattatttctgaaggattatttttgcttgatgtaaaattctgggttgataattctcttctttcacaactttgaaaatgttgttccaattccttttgccatccatggtttctaatgagaaatcagctcttggttgaatcattattctctaaaaagctatgtgcctggccaggtgcactggctcacacctgtaatcccagcactgtgggaggcctaggtgggcaaattacctgaagtcacgagttgaagaccagactggccaacatggcaaaacctggtctccactaaaaatccaaaacttagccaggcatggtggcacatgcctgtcatcccagctactaaggaggctgaggcaggaggatctcttgagcctgggagatggaggctgcagtgagctgagattgcgccactgcactccagcctgagcgtcagaacgagactccatctcaaaaaaaaaaaaaaaagtaatgtgccatttttccctgatttttttcaagattctttatttgactttattttccagcagtttcattatgacgtgtctgggtatggatttctttgcatttatcttatttgggatgtactaaacttcttaaatctacagtattgaatctatagtaggtttgtctttcaccaaatctgggaagtttccgttcattgcttcctcaaatattttttctgcatattactctttctcctttcttgaattccaatgacccaaatgttagactttttgttattctcccacaggtccctgaggctcttttcattctttaaaagtcttttttactcaaatgttcaaagtggatcatttttactgatgtatcttctgacctattttcaaattcactgattccttttctctctcgccttcattctgctgttaaattattctggtgagtttttcttttctttaactttggttattttatatttcaattctaaaagtatacacttggttcttctgtatattttcgatttctttgctgaggttttctttccattttttcaacagcgttcatccttacttacttgaagcattttcacaatagctgctttaacgtctctgtcagaacattccaacaattatataatatcagtgctggtatgtgttgattatgttttctcatgcacgtaaaatgatcctagtatactgagtaattttgcattatatcttggacattttgaatatcatattatgggcttctggatcttgtttaaatcatatggagaatgttgatattattgttttagcaggtaattgacccagttaggttgaggccacaagttcttgccagccttctgtaggttgtgctttcaatgtgggttccaatttcaaagccttttcagtgctgattggaactgtccctcatctgcaccgccaagtggccagtctgtgacctaggcagtggtctattcggctgtataggtcctatgtgagcatgcacagtcatcggtgagtttgagagctcatcaagaactttaagaggtttattttcccaaactattccctctccaccatctccccaggacattctggttccctggggctcttgtttgtggtcctctagccagaaatctgaagttttatttaccttaccttggtgcacatttcctgccacctgtgctgtgtttagggacaagtgaccagaagacagagaaagaaaaatttcaataggagtttgccacaccttcttgggatctcagcttctcccatcacagagaaaagttctcctctctcagtgttttaggctactgtcggtttttttctctattacatctacccaccctgctgtcattggattgcttgggctgaggtgtgagagaaaagagaaaagaaaaaaaaagtaggcgattccccaactctgagcattagaagaccattttcctgcttctagagccagaaatagaggtcttcttctggagctctctctctttaccccaagcctgcttccaggttccaggttgccttgtcttcatgctggcagatactgaaggaaaaacgggataaactcactgccagctcagtgctacttttaattcttgtcttctttccgctttcgcctgctactgtttatatttcagacccctcaaatacctgctccatgaattcattccaacttttacagccatattcactgggagacacagagtgaagttgtttactcttatccagtaccagagatccctagacattttatactctttggctctttgtttaggacttactttttaacgcattagactggaaagcctgtgagatcatggattgtcttttttactagtacaattctagcctggcacatagtaggtgcttaatacaatttttggtgaataattgattgattgattaatgaataaatgattaatgttgggttattagtttttcaaactctaaagctattgattcattttaagtagtaattcataatttttacttttacttaactagatagatgtaataccttattaagactcatatttaattcacatgtgtacttgcagttacacaaaaaaatatttttacatttcttacagaaatattcaattatagtaaagtgtaatttcatctgttccagctcctatggaaaaaaaaaagtgacacttttaactacaatataatttatattcaaaagtataataaccaacaacatttcagctaagcagggaaaaataatactagtagaccttacaaaagctattcgaatacctaaaacttaatctgtcctcttagtggcaaatgcttttctttccttgtatacaggaacatgctcacaccatcacaaacttagagatacactttggcaggaatctgcctgtcttttgggtaaacagacattccaattagttagtagctagatttgagctccttatcatgtgacctgtgtgtgacagccattatgcacgatgacttcagcttcttcagtcttgagctgtagcaagaaaggaatagtgcaattgaagtattttttaaatactgctgctatcagcaaagaaatttaatagatccataggctgttacaaagcctatatatatttcacacagaaggtcatgatagtaattcctaaaggacactgtctttcctttatgaagtttttttctccctcagtcacagagacagaaaaaaaacagagcatgaatagagaatgtacactttactccaaaaggcaattcctaaaacacagctcatggtaggttagtaaaggttagtgctttattttttttcttcatttcaaacgtaaaaatctcacaacaaaaagtattacaacaacttacaaataacaaagatgatctaatgtcagtgcataaatggggtctaggggggcaagacacggctaccagtaactataatttcaggctgctctgtagtgttatgcttttatgttctctatccaaggtgactgatataattggatcattatctgaacagagcctagagagattaataaaaaataaatgctgccttttccgtatgatatcttttctccattgaatttaaaaactgtcgtttccgtagttttcttctcctgagtcccttagaaggttgatcatgggctttcttctaggtcaaattctactgtccatgcccctgacactgaactgcacttgcctttctctggcctctactctgaactactcttacctagtaacagttataaactcatagtgtctagaaagtactatctttccagaaaatcatgatatttcactgtatatctcattttaatgcctataatggctttcctgaatgaggagggccaaggtaatcaaaagcaaattaagatacagaaaaaagaaaagttttatggcacattgcatatggatgaaagaagctacatatttgatattccaaatgcttgaccacaaatcagaacatctgggttctagtataaactctgctattgatctgtaactccaagtatgccatttactttccctagaccatttttttaatcttgaaattaaaagtaactataccaatctttttatttggatgaagaaattaactacttcttgaataatagtgactaccctgattttttttttctccctctgaatcaactaatttttcccctggatatctgaagacctgtgattacttaaaaattatttctttattcttaagcacaatgagtgaatcaaaatatgtctcagtgtcattaattgcaaataatttttcctgctatgaagtgtgtttccttaagtttcaagggattatttttctttgtttctaaaaaattttcctctactatatctctaaatcttttctcgctccagattttgtatggaagttttattttcagctgtgtctttctcatttatgtataagctaataacttgtgcttagttctcaatttgcttacttattgttcaatctccttttacatcttactcttttgtatcttcttatctttgtagttctattttaacttgatgaatattctttgtgaattcttctgtagcatgaacaattttggaatactttcttctgtatcctagtttgcattttattcaagattagattcttctggttttgctcttcctggctcttttcactcattttttccctctttctattactgattttcgttttctatttttgttccattctattagagcttctattttacttcttttcatctgtctcatatttaatatattttatactttctttttgtccagatacatttctgagtgaattccccttgacaccattcatactttatttcagggttttggtttttttgtttgtttgttttgttgttgttgtttttcctgcttgtctgagcttcaatttgagtgttttcaatccttcctgggtttatggaaatggattccgagtagttaacatttcattagaactcttttaaacagtcatcgggaaatttgagctctgctttctcttctgaaatcctgtaccaactcccagtccacccagcttgctctctgaactcagccctatttctcagaaaagaataagcattgtgcttcttttgccattgaatgtaaaagagcaattagtcagaaagatatgtttcttgatttttcccagtattgcttatttatctccttggtatgttttcccaaaaattgagtggtatttaggggacttcttgggattttattcaatttctatctttgctgagttattttctgctacactagactatgcagagttttggggttttttctgtcacttttcaattttacagcataagcttgtctcattttccttttctgctttctacttatttatttttttagttgcaaaaaataaaccagttttctatttagttaattaggctccgagaaaggcatttcctgtgattttgccccctttaactattatttcacagtcttcaatgtgtatcattattttattttatttctattactctaagctcccatttgttttgtgtaataaaatatttatattacaatcaaatacactgttataatactttgggactgtctatatggaggtaatcatatctaacgaggtaactattgggggctcagtgaggagcaatgcggagggcataccctgactatggacctcccaggtgcaatagttgaaagtaaaaatacatggaaagtttcgtgttttgtgttaaaactgcagctataccacctgcaaagctgaatgtgttcagatgtatcttttattacaatgctggacttcacacatcctgaggaggaaaagacagtggcttcatacgccagaagtcggatttccgggcttctggccacctatctgaatgggggagatcatgatcttctccagcccccaccccaactactagataaccatcactttctagctccactctaaacccatactcttaaagctaagtaaactatttgcactaaaattcaagtgagcttaatcatacatgagcaatcaatcaaatcactcctatatatttcaggtacaataccttcaaatccaaaaacaaagaaaagtaacttcaaccccctgaggaaaatcttttgttttatttattagagtgagtttaaacctggccacagaaaacacctacaaagagccattaatgttggaaaatgttagatctgaggtacagaatcaagatgcatgatttcctaagttatccaaaacttgtgaattcattcagcctccaccaaaattccaggatctggatacatctgaactttggaaaggatgtgaaggcccatccttctaagctttttacattagatatttttaaatttcatatacaactgtaatttatgctgggaatgatatgagtcgacggcagtggtatattggcaaatgtttaaaaaccagcccccttggatttaaagagaggaaaaccctaattgattgttaacttctgcagtggtataaatactctcaccgtagctaatttcaagttaccaatataatgtcactggatatggagatggaaatatatgtgctacagtcagttctcacaaggtgatgggaaccagttccagcacactactgtgtgcttaaaatataatattgcaagaacttcaagaatagtttaaacatacacaagattagccctatctggcccacacagccattcaattctttcctgtttcgaaggaagcaacgttgttggaagctaaagtaaagaaagagaaacacttttctgtccccacgtgagtttggaataatttcttctatccaaagcctgcaaatattttaagcccaaataatagcagttttgccctttagaatttattttttacaaagtacttcaggtactagtatgaacagcattaattatcaaaatgtaaactcttataacttttaacttctggaattacagttattaacgaggattatacaaataccttttataagttaaggcaaagcctacacacaattaaacacgagccaccatacgaataaataacagttaatactccaaggttatttcatactctgttcaatgacaactgcagctgtgccactatttaaagtgctgctgtgaaattaatataatgtattaggaaaaatgctatgtgcagctcttggagatgaagaaatctgagtgcgtggtagagaaaaaagaaagtaatagcagagaatagtctaaaagagaacatttagatattttgatttatttgtaaataatttgtataatcctctcaactggacatttttccaagttcaatatagactcccatcttcttttatatcctaatcaaaacttaactatcctatcttcagtgcctcagaattctaggctctccctttcaagtttgcaactgttaactgataaatgtgtcaaccttaaaggtatggtgtctaaccaaacaaacaaacaaacaaaaaaaactgacatctcctaggaataacagtgtgtttgtctttggagcattcctaaaaacacagtgccttcacccaacctttaaatagcatggcataactatttgcacagcacctgggatgagtagtcaaggcatctagtgactccagatgaccagctgggcttacatcactctaggctaggcccagccattgggaatgctgaaagaatgaacatctcaacacaacttaatctcatttattgcacaccagtgtcccacattacattggttggaagactgacttaacctaaaggaaaacaccctgttgcaagtttggttccctaggaaacaccctctgagatgaaagctagactgcagcacatttattgaggagtgtctttgggagcaacacttataggagggggagaaggaaacatcagtaagcagagcgggatgttgagctacgatgcaggcccactgacagcctcagccaaacccaagtggagctctggagctagaatggccccacaaaatggtactgagatgggcgaagatggccatgcctctattctcctacatcaatcagtcaacggatgtgagccacctcaggaaagagagtgaccttggacaagactgccctccacaactgtggcaatctttgaaggggctgaaaattgaagactgtttgccagcatccctcctagcagcgcagacaacacatcctttaatgaagggagatctggtcagtacattagtgtctactgcagatcaccaaactagatattctgaatattgatcggcctcaataccattcacttttgcaacataatcctgatcagagcatctctcagtacaatcaatggagaggctgaaagggaaacacatacttccacgactctgaaggcatagctgctacttatctatcgcagatttcatagctgcaacatatgaaatctatgaagatccattcccaagggaagagtccatgtaatcctataatcatctttttgatagcctacatggatgcatttggcatccattcttattcagcccaaccactgcccctcactttaagtatagatgtctagcttacctgccttactcaaagctggggccgactttcaccaatgcactatactttaaggagtaaagtgttatcacctaaaacagggacttaccatgaagggtttgctttttctttctggcttgactctgaaaataccaatattccctaagtggtactaaatttatagccggacatcatttaggctcagtggccttcacgtatccaattgtttcaccaggatgggagaacacagtcaaggcacaaaaagaagctactggataaaagaataactggatggagtggggaagtgggtacagaggagcagaatgagccaaagaaagacagttgtggaaaacttccactttccaaattttgcctccatttgcctcttcatgtattgttttcttagcaatctttggagaagtgccataggatattttcattcagctcttgatggaaaatacagactgtcttcactaattcttcaaataatgaacaaaacatcaacttaatatgaccccagaggaatgaaaacatagtttaaaaaataaaacacagttccatactaacataattgagtgttgaagaaagttaaattaatagaaaatgcaatggtaaagctatccacacatttgcatatgccattcccttcacctgaaacagtccccttgcttccacatgtctaaagcatgcctacccttcaattctaagtctaaatcctaattcatccatgaaggcttccccaaatattccaatcgtgtttcctacccaactgcacagtgctcaatgtctctgtaaaatatttgactttcatccttattttttgttgtatttctactgatcattcactatgtgccaagtacagtatttatcaacttcatattttttatcattgaatctttgcatgtacactattatccagttttgagtatgtccatttgatataaaagagagcagaaattcagggaggtgaattggcaccacaagcaaaatgggagaaggtgataaacccagttcagatatactacaatgtctgtgtgttctttctactgatgcctatactgtgcatgcttctcatttccctcaagtagaccatacacctcttgagaaaaggaattgtgtataatatcccttcctcgtacttttctattcctatcccacgtcatctcgaatgacaaaaagcatataatatcatacatatgtttgagaaaaacaaggaaaagaggctatcatataggggtatcaatgagtagattcctacaagtattccagaggattattcctgaggaactcaaaatttagcaaatggatacatagtttataaaaatattaagaacaatttggcaccagtctttctctgtttccatatggtggtgccaatttgtgacttagttaagacgttcactttctcacacagtaatgccgaaagcaagtgactgggaaaattgattaagagaggggtttatcaatggcatgaagaagcctaacacagatacatgtctggttgccttttattaaaataaatggaaattatttatcttcaaatgataacaatacaaatggaaacacttggcagttcccttgaatatataatgaaggattaccctcatacccacatttatatcctgcagtgtgcataacattgaggaaaggccaggaaagtgacaactccttaattagttagtgctcagtgacaaactggggaaacttgctctggaatctgtagagaaggaggagatggtagattgtctaaaagtctctctctcttctctattatatgtttcacaaagcgtgtgtttttatttcattgttaaagatgtacaaacccaacgaaatgagattcactaaataccatgctaaaaaccaaatgaagggttttgcttcatttagtacctgaatcaacactactttacctatcaaggcagacctgaaacctccttttaccaatttttcttctgatatgagaaaagcaattagaaccaactatcaaattttattcatcagtgccccgataagcaagctgtatgaaaaaaatattttaagtaattttcctaaaaatgttaccctgtaagcagtcacaccctccttctagagttatgactcatattatttattgaattacatcaaatgccgtactgaatttagtaatgatagctgtatataataattacatgctacattgcctccattggaaaccatggtaaccgatcagttactgtttcagccagccgccatagctgagaatagcacagaggaaaaatatacccatcatcacacacattcaatctgcagataacctgggagggagggctacatttggccatttcatccttttattgccccatttaggactctcctagaccatgccaggcttaattcttccccagagcctttgcatttactcttcttcctatctggattgctctccctctgtcctttacatagctgattccatcttgtcactcaggatttagctcaaatgtcatctcagagaagcctttcttgaccgcctgaccccaagaactaaactagttccctccaagtctctatcacctggagggcacttaccattttctgaaataatattggcatgtgtttatttacatgtatattacctgtacacataatgtgctgtgtgccatataacccctgggttattatctccttgagaacagtcaccttgtctttcttattctcaacaataatcttaatgtttatctccttctccaacaccatgcagtctttccccccaaaacaaataaaaggtaatactttgacagatacgtatactttgaagatatgtatatttcaatgacagatacacattagattctccacaaatatctgataaatgagaaaaaataaatggaaaagatgaatccaatcaatcaaacagcccctttctaagtggtatccctccaaatacttgaagaaaattatcctgccttatttgcaactcttctcagagatatacattcataatctcttcagttcttcttagacctgttttcaacatatctgaacacttctttatgtgtcttggacctctcagtttattaatatttcatcttaaaatctggcataaagaaccaagtcagagttttccgatgtgatataaccagtgcagatatggttactgacagacataatcaaaataacttcatcctgtgaggcctgctcaagccactagtcaaccagccaccctcctgaaatactaccttgtttctacagtggtaaactgaggcagatgtgggactaccctgtcgctatagtagtaatctgaggcaggtgtgatacaatgcagtgcttctcaaattttactatttagacacttccccttaagatccctgtcccttccttctcagatatatttcaacccttctgtaaaatgactggcaatgagatcaaacctttcttaaaatgaaaattctgattcagttggtttggagagaagcccaagattcaactatttctagtaagatgctggtctacaggcattattttgagtagcaaagctctactggaatgctgaaccaggaaaacagataatctagtttgaattgaagccttaccatttaataacagcatacaggtgaacaacttaattggttttcttatctataaagtagagataaatagaactatcttggagagagattttttaagagttaaataagataattaatgtgttggcacacagtaggaatgtaataaatattatctcaatgaatggccttctatcaatagaagttggcagttcatattgaacgtatagtcagaaaaaaactgacgtcttttcatagaaatggcttctaggcaaaatttcctctcatctagcatttgtacatttgatttttttttctgaacctaaatacaggatttaacatttataactattaaatttcatcttgttagctttggccagcattccagcctgtcaagattgttttgaattaagattcagctactcgatgtattagtcattgctccaagctttatgtcatctgcaaatttgataagtaagccttctatgtcattatacatatcattaaaatgttgagtaggacaagaccaatggctgagatattctacattttatttgttttgaaggaaagactattcatgggttagggggagaagctgagattgtttgacaaactaccaatctatttaactgaatattatccagtctacatttctccatttatccctctatagattccataaaatagtcctgtgacattggttaaatcaaaacacattatgcctatggaattttatctttccatctaaaactcaaaataaaaagtgaaacaagattagttttgcataaggtatcctcggtgaacctaagctatctcctagtaatcaccattttcttttctaagcattcaatcacaatttgttaacaacctattttgtaatttcaacaaacaagatttcatgttatagtcattagtagcatatgcattctgtgactagagactgttagacacattttccccaaattctcaagaatgttttatacatgtttaccatatgcaaacaccttttccttacccttgtaggtaattcatatagttctgaagatggaatcttttaaaacaggtaggcatgccttattccttacgtatctcagcatttacttccctcttgattatttttattctactctctctgttttcagtcccattttcctcaaaataaaagataaatctaacgtaataattgggtaattctaacgattgtttcttctgtaatctagctttcttttgagaataccctgtaaaaatccatactgatgggagttttccctttgcagccacaacagtttttgtatgtggctgcccctccagcaacatgttgtacatccccatctcttctcacttatatttcaactctgttttaaaaccattggtaatgaaataaaacctttcttttcttttttgtcaacatttttggaataaatagtgatctttatttaaagaaaagtttattctcctattttgacattataaaactacaccttccccactcacatttttgcacaattcatacacaatgaatcagttaaaacaagttggaatcttaatttatttgagatgccaattttccatcaaaataaaacaaactcagttgcctcctacacacatgtgtgcacatacataaagatacacacacaccctgactccatcaagtcccttggttctccactagtcttaccatgtcttcataggtccctttttaacagcctgcatgctaaacatgaattccttaggtgacactggccccttctgaaacccagtgatgagatgatgaaggaactggggtgaaccctacttgtaattgcttgtgagatggaggttccaaacacgatttttgctagcctcaagagagaaccaaggaacgtgacatagctggtagttgtgtatgtgtgtgtgtgtgtgtccatgtgtgagatggtactgttagttttgtttcgatggccaagtagggcaactcaaataaattaagatacctatttattttaactgatcaatttaatagaaacatgaatgtatatagatatgaacaggaaaggtatagtttcataatgtggactcggagagaaatggtagctagccaaaggtcacatacctttacagaccagaggtcttaagaagtttgggatgagcttagatgatacatagccagcagccatacagccatgagaagttccaatcactgtataggagtgttccacgaaatccctagttgctatttttacaggtgccctctacttgacacccataaagctaggagtggacactacttctccacatgtgcctcagaagaaccaaatgcatccaccaccttgcctttcgaaagagctgctgggccatgctatatggtgcttgcttctgccttcccaatatccagtgttaatatatccccttggcagacatgaagaacaccagctccaagggaatgtgggcaatgcagcatttaacatctctgtctttggggcactggaaagcacctagaagcagaaaagaatggtgttgagcttttctgcttggtgatacctggcagggaactactttctagattcccatccttttaaagaaattcaatgcacatcttctgcaaactcaagagattattcctgaatgcattccccaaggaaagatgttcaaaactagaaccatctcaaggtgtttgttctcttctaatattgttacagagcaatgaatgctcagggtatacgtcatcagtcttgtatttttcctacagcttgtttccacagcaattaagagcttgaggttatttggttgtgtttttcatgtttacaaaaatactggtggtgttgaaaggacagatgaataggctctctaagtgtggcagagaaagcaaagcagaactttcaattccacaaagcatctcacaaattctcctttattgccagcacaatctgcctctggctttaaaaacaataactgcatcttttcattcttctctcttaaaaaaacttgtccctgctctcaaagagacaaattttcattttttcctatgctttcaagaatttattaatctcagaagccaattattacaaggaagtggatatcacagaaagaaaacatgaactatagatttgggagataaatgagcagagggaaactcaagggtattttaaagttactactggtttcttcaccactgtgaaaaaccaaagactttcaattcctaaattcaggccttgaggtaacattagaacattgtgtatttatctgtacaactggacattgtatatttatcagccacttgtgtggctaactcctaaaattaccactgaaaagaagatttatgctttaggagtctcacttgcctctgtttgagccctaagatatcatggtcaacggcaccctcttaaaatctatttttaccagttataattgttaaggaataattttctagttataattgttatacagaaactgcacaaaattaacatatacaatttggtgattttgtacatatgtataaactcatgttaccttcacaatccaggttataaatatattcgtcacctccaaaagttttcttgtgtgcctttgtggttttgtgcttgggggaagtaagaacacttactatgaaatttaccctgctaacaaattttaggtacacaataccttattgttaactataggcactgtgttgtacagccaataaggccaaaattcttgtattttatatgcatctatccatatggccccagagttaatgggtgcctcctctactcgcttgccctttgaaaatgcacagagctagccatgccttgtagaggaattatttggccaacccacttcccattgcttggaaccaaccgtgaaataattagaacactgccatctctttctccattatgtttctagaaattagggcaaaataggaggctagaggaagcataaaataaaagctagacttcagaccagaggaaagctgagagaataactgttttgaggtatcctctgatcaatgccacttaatctgtcaccttctagtttgcgcatctgttcatgatccctattcttaatactcttgcttgatcctggatccttctcagaatacttagcctagctttagagaaaaagcttaagcaattaactacattgcaatgtgaaatgtggtcaatatctaaaagatgtacagttaaagcattatatataggaattcagaggagaggttactatatatgcttgaatacaaggcaagtcatttttctacaaatgacctctcccttatattgcattccgtatacatttttccagaatacatgttctatcagtaaatatactttgaacaacaaactactattccagaaaaatatattagcctaaaccagtgggtctcttacttcagtgtacatcagaatcaactggagggtttgttaaaacacagatagctgagcaccatcctaaaactttctgaggtctagggtggggctgaaacaggcatagttctaacaaatagccaagtaatgcttatgctgctggtctgaggacctcattttgaaaaccactgctctactaatattggttttagatcagtggttctaaactcttgttgcacattagaatcatctggggagatttcacaaactaacattccaaggctccgtcccagatcaattaaattagaatacgggagagaggacctcagtgtgccctgcttgtagtttttaatgcccttcaggtaattctaggctacggccagggttgaaagcacctgttttaaatcagtatcaaccaatttcagctaaaataatcagggttttttttttctatattacaagtcaccaagcaaaaaataataatcagttttttaaagaggaaaacacatttggcctaaactcagtaaataatcctggggcatgtggctttacatgtgcaaatgaggatacatggttaatttgtggaaatcactaatatatgcctaaagaatggaaaataagaaacaaaacactcttctaatcacacaggtacggatttttgcagcttgggttaaagcttctagtagcaacattataggaagtggtatatatcaaacaacataagtgaaagcaaagatggtatcttatgtaaaaccatgttggaggaccaaaaggagtgacctctaatgatcataaagacaatgatactgaaggtacaggtgccaagtttgaagaacattgttcaaaaaaagtgaaaacagaacaaagcactatttctaaaatcactgaggttttataaatgtgattttaaatatgcatgtgtaactctattgatacatttgatattgtcagtagactaatatagtaggaatatacattggtcaaatgtattgagtactagcaatacagatgtgaagccatcattgagaattatcttcaaaagtacattcgaaatatattcaaatatattcgaatatcttcgaaatacatgcgagtcagccaatatttttattctctgcatgcataaacttggataacatctcatacccagggatatacagaatttttggctaagagtatcaggaatgtctttctgggagaggtggtatttgagctggccttcataaaataagtaggtattcatcaagtaattcaaaagtagaaagttcttccaaacaggagaaaccacacgagtgatggaattgtgaaaagaaagcaaaaggtgagtagtaaagacgccaagatgaaaaagtaatacactgctaaatcgtggcgacttaacattaagataaggaaattttacttttattcagagtattttccagatgatgccccctccagtaacagatttctgattggaaacatccttattgctcctcaaccctcttcagccttcacttctcttcagaaaaaaacttgaaattttcgaaaatgactctaaatgatggcttaacacctgtattgctagtcctcatctgacttttaaaaactctatgtcatagactcccatgaacagttagagatcttgaagaaaaaaaagtcgtcacataaacgtagtattccagttacctattactgtgtaacatgcatccaaaaatttagtggcttctaaaatcaatttattatctttcatgattctgtttattaaccaggtgtttcttctgcctcacatggtgttggctaagatacagggatatctaaaaagttcagaatggctctactcacatggctggctaccggatggttactgagctcaactggaggctttagttctcctgcaggtgggactctccacatagctacttgggtttcttcacaatagggtagatgggttcgaagaatgaccattgaaaaaggtgaatgagtaagctacagatctcttaaggctcatcctttgatgttacgcagtatcacttgagatgcattccattccaaacaagtcagaggaatgggccagattcaacagggaaaaaaggcagactccaccttttcataaaggagtgacaagatcacattgcaaaagagtatgtgggatgggaaacatagttactgccatctttgaagacacaatgtaccatacacacagaagtctagccattaaccaatacgtggggacttcagggattagcagtaaatatgatgaaaatattgtacaaaattatataaattaaaacatttaaaaatcttcttaaagcataatgacaaatcaaaaattagcccagactgagaaggtaaagatctttactactcttcatcggaatggcataatagatatagataaaaccagctgcaatgttgtcagctaaacagtaggtgctggaccataataattccaaggaagcaaagtggatctgagttttaataaataaatatatatattaaatatttatatataattttctagaaaatatgatacatatacatatatataattttccaaaacacccttcatggtcatgtctttcttattcaacttaatgatggtagcagtggtgatagcagcaggaggataacagtagaatccatttttttaaatcataacatttttatggggatttccagtttccaattctgcatgtaaggaatttggaagtcatcactttgtcctaacgatagaaagctgaacaaactgaaaaatcaataattcttcttagatccataagagaagtgtggtcacaaggcaaactgctgcccccaaaattgaagagacagataggtggatacagagaatcacaacatagcagagcagaaacctctttgggaaccaaagctgatgcaggaaaatctggactgaaattgacaaattgccgtaggcagggcatggacaccttggagttaaaagctccaaggtgggcagggcatgatggctgacgcctgtaatcccagcgctttgggaagctgagacaggaggatcacaaggtcaggagttcgagactggcatggccaacatggtgaaacatcatctctaataaaaatacaaaaattagccgggtgtggtggcacgcgcctgtagtctcagctactcgggaggctgaggcaggagaatcacctgaacccaggaggcggaggttgcagtgagccaagaccgtgccattgccctccagcctgggtgacagagcaagactccatctcaaaacaaaacaaacaaaacaaaacctccaaggggacccagtaaagggaagcaggggttttatcagtacctaactgacctgggagaagggaaatactcaactccggtccactctagccaacctgcccaggctaagaggagaaaacaaaactgagaaacatttgtgaagttcacagtccagaggcataggctcattaaaagactgagatataatcaaaggattatagaatgcttcctcaacacacactttaccaccacattactaaagtcctatttacagcagttccttttacctatttctcaatatctggctatcaataaaaaaaaaaaggcatactaaaaggcaaaaaacataacaaaacaaaacaaaaacacagtttgaagaaacagagcaaacatcagaaccagatatagtagggatataggaattatcaaacaaggaatttaaaacattaatcataaaatcaaatatgctagaggctctattggttaaagtagacagcatgcaaaaacagatgggcagtgtaagcatagagaaatacaaatcctaagaaagaaccaaaaagaaatgctaaaatcagcaacactgtaacagaaatgaagaatgcttttgatgggcttattagtagactgaaaacagctgtgcaaagaatcgccaagcttgagaatataccaatagaaatttttaaaagtgaaaagcaaagataacaaagactaaacataaaaacaaaataaaaaaataaaaagaatttaagaaaaagataagactgaattaaaaaatcagaacacaatattcaagaactgtgggacaactataaaaggtgtaacatacatatattgggaatactagaaaaagaagacaaagaaaggaacagaaaaaagtatttgaaaaaataatgactgagaatttttccaaattaatatcagaacctaaccacacatacatgaagttcagaaaaccccaagcagaataaatgtaaaaaaaaaaaaaaaaaaaaaaaaaaaactacacctaggcatatcattttcaaactacaggaagtcaaagactttttttaaaaaaattcctggctgggtgcggtggctcacgcttgtaatcccagcactttgggaggccgaggcaggcggatcacaaggtcagcacatcgagaccatcctgactaacacggtgaaaccccgtctctactaaaaatacaaaaattagcggggcgtggtggcaggtacctgtagtcccagctactggggaggctgaggcaggagaatggtgacaacccgggaggtggagcctgcagtgagctgagatggtgccactgcactccagcctgggctacagggctacagagcgagactccgtctcaaaaaaaaaaaaaaaaaaaaaaaaaaaaaaaaaaaaaatcctaagagaagccagagaggaaaaataatttacataaagagaaacaaagataagaaatacatctgacttctcttcagaaaccatgcaaacaagaagacagtagaatgaaatacttagtattgagagaaaaaaggcccaccaacctaaaattctatagtctacaaaattatccttcgaaaaaaaggcagaaatcaagtttttcttaaacaaacaaaaactgaagtaatttgttacctatagacctgctttgcaagaaatattaagttattcagagagaaggaaagcaatacaggtcagaaactcatatctacctaaagaaagggcattgaaaaaagaatgaatgccagtaaaataaaaactgttactttttttattcttaattgatctaacatctaacagatcaaaatcatactagcaataatgtatttcattatacatacttgtatgtgtatgtattcatatatatgtgtgtgtatatatatatatatatagtgtgtggggtatgtgtgtctgggcttatataaaggcatagctcattttattgcattccattttattacaaattgcattccatttgtaaaaaaaattgcatctttttataaattgaaggtctgtggtaaccctgtattaagtaagtccatcagggccattttttcaacagcatgtgctcactttctgtctttgagtcacgttttggtaattctcatagtatttcaagatttgtcattattattatatctgctatgatgatctgtcatcagcgaccttttatgttactactgtaattgttttggggtgccatgaaccatgcccatataagatggcaaacaatagataaatgttgtgtatgttctgactgcttcaccaacggccattcacccatctctttctctttccttggacctccctattccctaagaaacaaaaatattgaaattaggacaactaataaccctacaatggcctcttaagtgttcaagtgaaaggaagagtcatatgtctctcgctttaaattcaaagctagaaatgattacacttagtgaggaaggcatgtcaaaagccaagagaagccaaaagataggactcttgtgccaaacattggccaagttgtgaacgcaaaggaaaagttcttgaatgacattaaaagtgctactccaatgaacatgtgaatgataagaaagcaaaacagcctttttgctgatatggagaaagtttgagtggtctggatagaagatcaaactagccataacattcccttaagcaaaggcctagtccatgagaagggcccaactctcttcaattctatgaaggctgagagaagtgaggaagctgagaagaaaagtgtgaagctagcagaggttggttcatgaggtttaagaaaagaggccaggcgcagtggctcacacctgtaatcccagtactttgggaggccgagatgggtggatcacctgaggtcaggagttcgagaccagcctggccaacatggcgaaaccccgtctctactaaaaatacaaaaattagccggatgtggtggcatgcgcctgtgctcccagctactcaggaggctgaggcagtagcagcgcttgaacccaggaggcagaggttgcagtgagccaagatcgcaccactgcactccagcctgggtgacagagcgagactctgtctcaaaaaaagaaaagaagagaagagaagagaaaaaaaagaaatgaaaaaagaagccatctctataatacaaaagtacaaggtaaagcagcaagttctggtataaaagctgcggcaagttatcaggaggatctagctaaaatcactgatgaaagtggctacattaaacaacagattttcaatttagatgaaacagccttatagcagaagaagatgttatctagaactttcatagctagaggtgagaagtcaatatgcatatgaaaagatgctttctttaatcagttttgtagctttcctcatacagattttgtccatgtttcattagatttatacctaagtatttcattttggggggtgctacagcaaataacactgtgtttttaaatttcaaatcttacatgtccattgttggtatataggagagcaattaatttttggatattaactttatatcctgcaaccttgctataatagcttattagttccaggaggattttgtcaattctttcagattttcaacattgacaaatatgtcatctacaaataagaacagttttatttctttcttttcaaactgtgtatctcttatttccttttcttatctttttgctagctaagacttccagtatgatactgaaaatatgctccacatcacgtgtcattagggaaaggcaaattaaaacaacaatgtgataccactatacatctattacgacggccataacccagaacagtgaaaatagtaaatgctcgcaatgatgtggagcacaggaattctcattctttgctggtagaaatgtaacatggcacagccactttggaagacagtttggtgatttcttccaaaactaaacatactttactatacaatccagcaatcacctccttgttatttacccaaaggaattgaaaacctatatctatacagaaatttgtacacagacgtttagagcggctttattaattgccaaaacttggaagctgccaagacatcctttagtatgtgaatgaataaactgtgatacattaagacaatggaatattattcatatgctaaaaagaaatgagctatcaagctatggaaagacactgaggaaacttaagttcatattactaagcgaaagaagccaatattgaaaggctacagactatattattccaactatatcacattctagaaaaggcaaaattatggaggcagtaaaaagatcagtgggtttccaggtgttaggggaaggggaggtatgaataggtagagtacagaggaattctagggcagtgaaaataccctatatgatagtataacggtggatacatgccattcatacatttgttcaaatgcatagaatgcacaacgcccatgtaaactatggactctcagtaataatgatgtctcagtgaagttcatcagttgtaaccagtgtaccactctggtagtggatgtttataaccggggagactatgcatttatagggtacaaagtttacgggatatctctgtatcttcccttccattttgttgtgaacctaaaactgctctcaaaattgtctttaaaaaaatcttaactaccatttactgaattattcctctatactaaggactggaagccatcatttaattctcactcaacatttaattctcacaaccaccctatgagaaaagtaccaccacctcaattttatagaaaagagaagcctaaagaggttatacacttttcctaaagtacacagctagcaacccatgaagatggggttctaactcaggagttgacaggtttgttgttattgttttctataaaggaccagagagtaaacaatattggctttgtgggtcacttggtctctgtctcaactacacaagtactctactctgccactatagcatgaaagtggccaaagacaacatgtaaactaatgagcatgattgtgtttcaacaaaactttatttataaaaataagcagtgggtaagatttggcctgcaagccataattttctgactcctattcttgctcaagactgatctaagcttcttgactcagatttcatgaaaaaatgttttttatatctttacatccccatcaacatctagcacaccaagcacgtatgcataggcactcaataaatatttgttgatggaatgaccaataaataaattaattcaactaacacttattgggcatcaactatgtcctaggcactgttgtaatcacttgtcctaggcactgttataatcacttgatatatgttactgaacaaaacagaaatccctgcctgtgaggagcttacaatttacaaatctccaactcatatagcataattatacgggtttcatattgctgccataacaaattcccacaaacatggtggcttaaaacaacacaattctgttatcttactgttctgtaggcaagaagtccaacatcagtctcaccaggcgaaaatgaaggcattagcagggctgcattcctttttggaggatctagcggaagatttctttcctcactcattatggttcttggcagaattcattctctaaacactcccagtatctcagatactcccagtgtctcagaactagcaactgggtgttgaatcattctcctgcttccatctttctttctgactacaaccgggaaatgttctccaattttgaggacccatgtgattgggtccttaaattgggccgacttggataatacagtataatctccccatctcgagataacgttagtcacatttgcaaagtctgtttcgtcacgtaaggtaacatattgacaagcgccagagagtagaacatgggcatcttttgggggacattattctgtctaccacaaatgccatcatagaattttatattaaatctgatgaatttgatctttgccaatggatcataattctagtgagtcaatatgacataaataataaattatttaattataaataaaattataaattaatgtgtgtgataatccattaatctcagaataaattacacttttcccagctttgctcaaacctgtagatctgagaattgctactgctcaagccagtcctaaataatgccagcagttttcaaagactcttacctaaaattaaaaacattaaaaataagtctttttatcataagcctggcatatcttgaaggaattctccattttgaacacaaactgtgcattcttagctcctgcctaaaaataggattcctacatgtcattgaattgaagtgctgcccctgcccttgccatgttagctcaggccacttgactgggcctctgcctttgttttatgatttgcctttcagtcccctaacattgactagaattttagctgcaaagctgtcatcttccctaacccttaccaatccccccaactgcatttatattacaggcagtggtcacgtcttcctccaactgagatggacaatatcaatcataatgcaagacttttagctccaggagagttactctctggtttgcccaaccttttattgatgatagacactatctaaactggcccagtttcccctaagccacagcattgaggcttggtctgctcatcactctagcttctcaacaccaggcctgcccttaaagctagcctagttcccaaaatccaaccctaggtgtattatttgtcttccttaatggccccaccatctacccacggttaaattaaaaaccctggaggaattttcaattccactctgcctttatcaccaactttaaatcaccatattgttctgatcaccatggaacaaacagagaaggactggcttggcaagggaaataacagtttctgttttagagaaaaggcccacttttcacccctagacattcagcaaccctcgccaatgaagcaccctcaggtcacgggagaaggttctttataatctctggaatgaagggagacttttgaaagttctggttctggttcgagtagaaagaatattaatcttagagttttaaagacctgatttcttttttaggctctgccgcctactttgaccattttttcaactaggaaatgcaaataacacctaccttacggggtggctgtgaaaattaaataaggtaatgagtatgaaagcactatgtaaaaggcacgtatcagctgttatcattatgattatcctactaataccccctgtctccactgcagcaaatattactactgttcagggtgatgggtgaatattataaagctaatcattcagatgcattcaaaagaccattcacttttgttttatcgtattagcagaggttattttattctaatcctgtccatcaagttacattttggacagagctcagtctgatcgaacctgccaatatcagcttgggtctacttaaagattcattcaaccaccttctctgaaagcacaagccaacatttgtgtatatctgtatcataaatcacatgctaacaagtgccaaaagcagtcacctcttttatgaatcagtcattgattcccaagactgaattagccccttcttctcctatttaccatcatatgttgccaactctgtgatagcatttataatatggcattataatggtgtctttgaccttctacaagagatggtgagcaactgtagggtagagatttagtctttgtattctcattcatggcacacagtagatagccaatacatgtttattaaaataaaggagggagagccgggtgcggtggctcatgcctgtaatcccagcactttgggaggccgaggcgggtggatcacctgaggccaggatttcaagaccagcctgaccaacatgaagaaacccggtctctattaaaaatacaaaaaattagccgagcatggtggcacatgcctgtaatcccagctactcaggaggcagaggcaggagaatcgcttgaaccccggagtcagaggttgcagtgagccgagatcgtgccattgcactccagcctgggcaacaagaatgaaactctgtctcaaaaaaagaaagaaagaaagaaagaaaaataaaggagggagtagaaggagatccacactataggggaaattaccacttaaatagctacattgctctagcatattttaggtatgcagggatttcaaagaaaggagaaacaaaataaagaaaaaccattctttccaaaaatctccagtttacttttctatagcatgtttaaaaggtgttatcagttgtttgtaagtgcaatataaattaggctaattattccaaacacttcacattagagatacgtgaaagaagcagcagtttatttgaacctctcagctcttgaatgacctgtgccttctggagaaggagagagcttaagttttatttagagaaaaatccagcattacatatagaatatagatgtgtttctgagaaggaagaccagagagggaggaaaatttctcatttggaaagttgttcctataagaattttaattacatactttcaaataataacatcacctatcttgatatcatataatcccttcttggtaatcttccttgatatttaagtctaaaattagcccaagtaacccttggattatatgcaaatgaaaattctgtgctattgcagatactttttaaggcactgctaccattggaaaacatgattctcctgggttaggtaagaggtcagggcttcaatgactaccctactgcgcttcagtcatgcatcacaaatgttgacatgtacccctgagagtcttgcggaaatgcagattctgattcagtgggtatgattcagtggatccaggtcatgtacaaaggatcggaaatgagactatttctgaccttttaacatttccaacaatttcccaggtgatacccaagctgctgatctgcaaaccacacattgagtaacaaagttatcatagacatggtgatttttaaaaattcactatcagtgaaattttttaaggtaatctgccactgcacttcccctatgtcagtggttatgaaaattttccacttaacaccttttacttgagagaataacagctttaataagcagccttgaaacactgaagcttttagttagtccgaatttaaccactatgcaaaatgtggcttatgtgatgattaagaaatgataacatccttggcagatgaggtaagttatatttaagctacattttttcttcaaaaagtcctttttctatggctcaacatgggaataaaagggattctcatctcacgtgaccatttcccagtaatgagatagctcttggaataatttaactgaccaggagagccaatccagagagcccttaatcagtaatgacaaattgaagcaccttaaaagtaaaagaagttgtgttttccaacgcttgccattttagattttagccatgccctagagttataaaactgcttcctcatcaatccattctccatgccactaacattacttattttggctgagcattcaagagtagaaattttaaactaaatgatagaagaactacagctcctagacagcatacattacgccatggcagtattgaaaatctgcaggccctcacactcagattgaaagttttccctctcattttccccttctcactaatcctctttttttctcagtttcctccctaccttaagcagttgatatgctgtataaaacttgtggatgaagtaaatcttatgagaaaaagtatattttaagtgcacttaacaaaaattactttttgtgatgaattctatataaagaaataaattattctttgtaaacaaacattccccaaatatctgttaacaaatttttcaagctcttgtctcatcattttaaagcagaatatctctacactttcacttaacacatcactttaaatactttcgttttgtttacttcaacaaagggaaactaacagccatgagattggtgaaggatctggggctatcaagagcagtagatggctactagtagtagggcagaaaaataatggagagatccattatctagaacccaggaagatctgtggttataggaaaaagacaccctgtgcccttggatacaggaatacagccacttcccttccactggtcaaactgaaccctaaattgacaatgtcaatagaggtcagactcctaaagcacagagcaggacagcagggtagaaaagcatggagatagaacttgtaaggctgtaaaaagagcactgggcacagtggcaggtatacgtaacatataggaaataggagagttgagggaacattcacttactgaatgctgagaccattaatcccttccccacagtcacagtagccaggcttcaatactcgaggcaggagattggatggttcatctctaggggatgaaaaagaaatgaaaaactagattaaatattggaagacaaaattgagaaaaaaataatgtaaagcaaaaagacaaagaaatgaaaaattagaggataagaaaagtgagaaggaagccaacagttccaacataaataaacagttatagagtcccagaacatgaagggtgataatgaaggagaagaaatcatcaaaaaataaaattcagcaaaactttccagatggatttccagattggaaagacttgccaactatgcagcacaatagatgaaatcaggccctcaccaagggaactttaccatagaatttaagagcacggagacaaaatgaagataccgtgagcttccagagagggagaaaaaacaggtcatatacaaaggatcagaaatgagactatttttgactttttaacagcaaagtaagaagcctgtaggcaatggagcaataccaccaaacttttgaaggaacacaatacccaacctataattctacacttagccaagttaccaattagaagactttttcagatatgcaaaaactcaaaattttatctcctagcatctctttctcatttggttactgaaaaatgtgttatatcaaaatgaagggtgtaaaccagaatagaggaggaagtcgaatacagaaaacataaaactcagagacaaagatatcccagaatgacccatatgcaccatgcagagaaaataaccagtccaattcagagagatttcttcagaaaaaaataaaatacctgatgcattagggagaatttagataattaattagggagagaagttgagttagtgataagttgagttagtgataattatactttatgttatagggtaactataacataaggcaattattagtatcagaaaaaaatattttgcaaaaaacagcggccgggcatggtggctcacgcctgtaatcccaggtttgagctctttaaataatatcatatttcttagaagttttgttcatttaaaaaattctcactgggcgtggtggctcacgcctgtaatcccagcactttgggaggttgaggcgggtggatcacgaggtcaggagatcgagaccatcctggctaacacggtgaaaccccagctctactaaacatacaaaaaaaattagccaggcgtggtggcgggcgcctgtagtcccagctactcgggaggctgaggcaggagaacggcgtgaacccgcgaggcggagcttgcagtgagccgagatcgcgccactgcactccagcctgggcgatagagcaagactccgtctcaaaaaaacaaaaaaacaacaaaaacaaagaatcacaatatatgatgcagctcagttgtagtgtttacacagttacactaatgtaaatattgaagattgaagatttcattaacttacaagaggaagtctgaatatgtgaggatagaggaaaaaagagaacggaattgtcatttttctttctggaatgtcaatcaataatatttatacccagaaaatcaagaagtagaaataaaagcatgttatttagggaaatagagataaatactcaaagatatagctaaatgatcattgtagttttctgtataatttgtacagaaataataagcggacatatttttctgcattcaaaatttaatgaaaattttaaattaaatttaaaatatgaagataaatttcaaaattttaaagataaataatataggatatttctttcacttctgaggtatgatagttcacaaattacagcatgcaattcttgtctttctttacatgattgtttttaatatattcagttgcaaagggatatgtttgctttctaattatttcataaagcatgattaaaccaaatgttagcgttgaagtaaatgactcatcttattcttttgtccactaaaacatgaataaagaacctagatgcatctttgaaaatttctacaatttctaacattgattaatctttgtaccatatttagattattatgacttgaaattcttcttgaaagttggcattaccgttaatgaaatactggaagttttaaataatggaaactccttgctatataatagatgaaaattgtaagtcttttttcctaagactgactttctttgtcaagactttgatgaacagtttctaataatgacattttcccaggacaatttgaaaattatactttagaattcttaattaagttctgttgcttcaacatgccaacactatagcacatcaacaatgtgaattttctcctccactttgcataatgcctcttaaaatctatgataggaaaaatttatcttactcatttcatcaatctcctaactagaaaaaaaaataaagaggatatggcttcatagtgtgcttagagagcggacagaaactgagaagtatgctaagaaaatacaaagatttacttaaaattcgtttgcatagtaatgtgaaaatatatgtccatgactatttaagtcatgaaaaaatgaataggagaattgaagtgaaaaaacataattatcaattccaaatcaaaacatgaaaaaataatatcaagctctttaattcacattttatatgtattagtttatataatcctaaaaacaagcctataaaatgaacactattactatagtaacctattttacaaataatgaaaccgagacatgaaagtgaagaaatttaccttgctagaaagttgtaaatacggaaagtaaaagtaaacccaaacatctttgagcagaaactatcctttaagtcactattctaaaacaatttatatttaacttttagctaattacggttttccaacagattctatttgcgtagtaaaaatataagaacagtttatctttctcctcattcattttcaacttcaatgctgttatgcattttctccagtgttcgtgatccagtcctaatctagctttaagaaaaaaaaaagcaatcaactggagccaagatggccaactagatgcaaccaggaaaagctttgaccaacaagagagaccagaccatcaagtagaccaggatattctgaacagatttttagaaagaaggcattttagaaagaagacatacaacaaatgcaaaccctggatgataggtgaggaggctgggaaccctgtagggggttgccaagcaccaggacttgttcctggccctgagaagctcctaggaaaagggtgagtgaaatgggtgtggagtgacccactttcaccatggacctccatgatcctagctatgggagaccccacaattcccaggcacatttgagctggcagtgagaactgcctagcaagttggcagagacagaactccagcctgtgtggagcccagagggtttggcatgagactggctgcagtggagcatgaccatgggcatccatcccccaagactcgccatactcctctaggtgactttaggctttgttattaatagctgccagacctgggcagagcaaggctgtcttgcccttgagaaagaaacagcctgatctgaaaaccccctgtcttctggcctctcccaggattcctgcctggctgaagccacttgcagcacaaccactgccatagctctttcaccagcataccccacctaatcattggagtgcttctgcaaatggacatccaccagcagacaccaatccacagccttccccaaccagtgtgcaatcacctgcaacctccccccgctgccctgccagcacacacgtgtgtgcagacctgccaccaccttgccagcacagatgtgcacgggagcccaccactgcaccaccggagtgcttttcccagaagccccatcagagtgttgttgctagcagacttggaacactctaacctctccagcatatcaggtgcttaacctcaaaaggccagagaataaagctgtgggtttggtaccagcctcccgagtttatagcatgtagcccagcagtgctgagttgagtcttggcctcctgaaaccatccagaaatgaagccaattgactaagcccaacttacactgcaatcaaaccctcaaggacctcaaggaatacaaaagcaaaaaggctcatccaaaagacagcaacatccaagattaaaggaacatcagcccacacagatgaacaaaacttccaagaaatatggtattatttaaagagatcaaacctacaagtcactggcattcctaaaagagatggagagatagaaagacatttggaaaacttatttgaggatattgtccacaaaaattttcctaaccttgctagagaagtcaacatgcaaattcagaaaattgagaacccttgcaagatactgtacaagatgaccatccccagacacatagtcagcagattctcaaaagtcaacatgaaggaaaaaaatcttaaaagcagccagagagaacggacaggtcacataaaaagagaatgtcattaacagttgacctttcagcagaaaccttataatccagaagggattgggggcctatattcagcatccttaacctttttaccatttagaaaaaaaaaaaaaaaaaaaaaaaagtgcagctcactgccaatgctcatttaattttatataaacacactctttgaggctgaagaaaatctgactgattttcaatgtgaaaataaaatataaaaactgttcttggagttatttctaaatagaactaagaccagaattgtttgaatctttagaatcatctatttcaggaaaatcagattcatcaaattaatctatggccaataactatttgagaacaatgttaacatcatacataggattcctacattttctaaaatgtgacattctcagtgatcaagaattactatactttgtaaatggaaataccactactataaacagaatgctataaatataataatgtcttttgtttctaagttgatatactggagcaatgcaaaaataataataaaaatgagatattttgtggtaaatttatctcagagtaaatgctgcagctgccagcaagtattcctggggtatatgggaaaagggttaaagacaagaaattccaaccaagaattttatatccagccaaactaagcttcataagtgaaggagaaataaaaatccttttcacacaagcaaatgctaagggaatttgtttccaccagacctgtcttacaagaggttcttaagatagtgctaaacatggaaatgaaagactggtacctgccaccataaaaacacacttaagtacatagctcactgacattataaagcaactatacaatcaactctacataacagacagctaacaacatgatgacaggatcaaatactcacatatcaatattaaccttgaatgtaaatgggccaaacacccccacttaaaagatacagagtggcaagtaggataaaaaagcaagactcaactataggttttattagtcagagttcttcagagggacagaaccaataggatatatgtatatataaaagggagtttattaaggagaattggctcacatgattacaaggcaaagtcctgcgataggggaaaagaaagaagccatcagtggctaattcgggttcgaaagcctaaaaaccagggaagccaacagtgtagccttcggcctatgcccaaaagcccaaaagtacctgggaagctgctggtacaactcccagagtctaaaggctgaagaacttacattctgatgtccaagggcaggaggaggaagaatggaatcaagcatccagcatgggaagaggaaagagagccagaagactcagtaagtaaacttatcccaccttcttctacctgctttgttcaagctgccctggcagctgaatggacggtgcccacccacagtgagggtgggttttcctctcctagtccactgaatcaaatgtcagtctcctctagctataccgtcacaaacacatgcggaaacaatactttacaagccatctaggcatccttcaatccaatcaagttgacacctaatattaaccatcacaattgtcttcaagagatccacgtcacatccaatgacacccataggctcaaagtaaagggatggagaaagatctatcaacgaaatggaaaacaaaaaagatcaggggttgctattcttatttcagacaaaacacactttaaaccaacaacaatcaaaaatgacaaaaaaaggcattacatgacgataaagggttcaattcaacaagaagacttaactatcctaaagatatatgcacccaacactggagcatccagattcataaaacaagttcttagagacccacaaagagacttagatgacaacacaataatagtggaacactacaatatcccgctgacagtgttagacagattatccaggcagaaaactaacaaagatattcgggacctagactcaatatttgaccaaactgacctaacagacatctacagaacactccacccaacaacaacagaatatacattcttctcatctgcacatggcacagactctatgattgaccatatgctcagccataaagcaattctcaacaatttcaaaacactgaaatcacatcaaccatactactggaccacagcacaattaaaatagaactcaattccaagaagaactctcaaaatcacataattacatgaaaattaagcaaaattcagcatccttaaccttttcccatttagaaaaaaaagtgcagctcgctgtcaatgctcatttaattttatataaacacactctttgaggctgaagagcctgattttcaatgtgaaaataaaatataataaatgatttttggggccaggtgcggtggctcacgcctgtaatcccagcactttgggaggccgaggtgggcggatcacaaggtcaggagatcgagaccatcctggctaacatggtgaaacactgtctctactaaaaatacaaaaaattagccagatgtggtggcgggcgcctgtagtcccagctactcaggaggctgaggcaggagaatggcgtgaacccaggaggcagagcttgcagtaagccgagatagcaccactgcattccagcctgggtgacagagtgagactctgtctcaagaaaaataaaaataaaaataaataaatgacttttagataaagaatgaaatcaaagcagaaatttttaaaaattcattgaacctactgaaaacaaagacacaatgttccagaatctctgggacacagcaaaaccagtattaagaggaaagtttatgatgttaaatgcctacattaaaaattcagaaagattttaaattaacaacctagcatcacacctaggggaacaagaaaaacaagtgcaaaccaacctcaaagttaacagaaggaaagaaataaccaaaatcagagctgaactgaaagaaattgagacaagaaaatccatgcaaaagatcaactaaaccaaaagttggttagttgaaagaatagataagattgacagaccaatacctagattaataaagaagaaaagagagaagagccaaaaaatccaatcagaaatgaaaaaaaaggacattatcactgatcccacagaaatacaaaaaaaaccctcagagactattatgaatacctctatgcacacaaactagaaaacctggaagtagataaattcataaaaacacacaacctccaaagatagaaccagcaggaaatttaaaccctgaacagaccaataatgagttccataattgaatcagtaataaaaaacctaccaaccaaaaaaagccctccatgatatatatttacagctgaattctaccacatgtacaaagaggacctggtactaatcctattgaaactattccaaaaaacagaggaagaaggactccttcctaactcattctatgaggacagcatcattctgataccaaaacctggaagatacacaacaaaaaaagaaaacatcaggtcaacatccttgatgagcacagatgcgaaaatcctcaacaaaatactggcaaaaccaacctagcagcacatcagaaaactaattcaccacgatcaaataggctttattccagggaggcaaggttggctcaacacataaaaatcaataaatgtgagccatcacataaatagaaaaacaacaacaacaaaaaaaacccacatgctcatctcaatagatgcaggaaagacttcaataaaattcaacatcccttcatgttaaaaaccctcaacaaactaggcatcaatggaacatactgcaaaataatgagccacctatgacaaactcacagccaacatcacaatgaatgggcaaaagctggaagcattcccccgagaaccataacaagacaaggaggtccactctcaccactcctattcaagatagtactggaagaactagccacagcaatcaggaaatagaaggaaaactcatcaaaataagagagaggaagtcaatctatcgctgtttgcagatgatatgattccatacctagaaaacccctttttctctgcccaaaggctcctagaactgataaacaactgcagtaaagtttcaacataaaaatcaatttacaaaaatcagtaacatttctatttatttatttatttatttatttattcatagagataaggactcacaatgttgtccaggctggtctcgaactcctgagctcaagtgatcctcccactttggcctcccaaagtgctgggattacaggcgtgaaccaccatgcccggccccagtagcatttctacatagcaataacatccaagctgagagccaaatcaagaatgcaatcccattcacaaaagccacaaaagaattagaagtacatttaaccagagaggtgaaagatctctactacaatgagaattacaaaatactgctgaaagaaatcatagatgacacaaacaaatggaaacacattccatgctcaaggattggaaaaatcgattttgttacaatggacatactgcccaaagcaatttacagattcaatgctattcttttcaaactaccaacatcatttttcacagaattagaaataacttttctaaaattcatatggaaccataaaagagcctgaatagccaaatcaatcctatgcaaaaagaacaaagctggaggcttcacattacctgacttcaaactgtaaggctacaataaccaaaacggcatgataattgtacaacaatagacacatagaccaatggaacaggttagagaacccagaaataaagcttcacacctacaactatctgacctttgacaaagtcaacaaaaacaatggggaaaggacttcctattcaataaaaggtgctgggataactggctacctgtatgcaaaagattgaaactgggcctttcaccacatacaaaaatcaactcaagatggattaaagagttaaatgtaagacctcagactaaaaatctctagaagaaaatctaggaaataccattctggacatacaccctggcaaagatttcatgacaaagtctccaaaaacaattgcaacaaaaacaaaaattgacgagtgggacctaattaaagagcttctgcacagcaaaagaaactatcaatggagtaaacagacaatctacagaatgagagaaaatatttgcaaactatgcatctgacaaaggtctaatatccagcatctataaaaactcaaaccaattaacaaccaaaaaaccaacaaccccattaaaaaatgggcaagggacatgaacggatacttctcaaatgaagacatatacatgtctaacaagcatatgaaaaaatgctcaacatcactaatcattagagaaatacaaatgaaaaccacaatgagataccatctcacaccaggcagaacgactatcactaaaaagttaaaaaacagtaacagatgctggcaaggttgcagagaaatgtgaatgcttatatactgctggtgggaatgtaaattagttcagccactgtggaaagcagtttggtaatttctgaaagaattttaaaaagaactaccattcaacttagtaatcccattactgggcatagacccaaaggaatataaatcattttaccaaaaagacacatgcattcctatgttcatcatggcactattcacaatagcaaagacatggaatccacctagatgcccataaacagtcagctggataaggaaaatgtggtacatatacaccatggaatactacacaaccagaaaaagaacgaaataataacctttgcagcaacatacatgcagctggaggccatcatcctaattaacacaggaagagaaaaccaaataatgcatattcttacttataagtaggagctaaaaactgaatacacatggatacaaagatgaaaacaatagacactactggggcccacttgagggtaaacagtgggaggagggtgaaggttgaaaaactacctattgggtactatgctcactacctggtgataaaattatttgtaaaccaaaccctagtgatgtgtaatttacccatgtaacaaacctgcatttgtatcttctgaacctaaaacaaaagttgaaaaaaaaaaagtagccaggctcggtgactcatgcctgtaatcccaacactttgggagactgagtcgggcagattgcctgaggtcaggagttcgagaccagcctggccaacatggtgaaaccccgtctctactaaaaatacaaaaatgagcctggcgtggtggcaggtgcctgtaatcccagctactcgagaggctgaggcaggagaatcccttgaacctgggaggcagaggttgcagtgaccccagatcgtgccactgcactacagcatgggaggcagagcaagactctgtctcaaaaaaaaagaaaaaaaagaaaaagaaaaagaaaaaataagaaaagaaaaaggaaatagaaaaaaataccaaatctgaaaatactgtcaattataagtcctaccaaaatagtaatttctggtttccactaaatatacttcctttgtttgactcatcacttggaattgtggatgttttgacttatttggggcataaagtgattccctggcctttttaaccacacagtatgcacaaccttcccttgctattctctatcttcttcttaaggtttatttttctccataatacctatcataatctgacattacattatatactatatccatttgtttatatccttttgcttccaatataaattccttgaggacaaggagtttgtcttgttttccattataaacctcatagccagaactgtgcctacatataatacatactcaattaatacttgttgaatgaataaattaacaaattgtttttcacttgtaaagagatatcatcatgtatactaaggagatacactaaacatcgtagcattacattacatataatgcatcataaattgcatatagttaaattcctagtgatctttaatttgatatctattcaaaagtctttataattggcctttaaaagtattactactttgagtctacttataattttgtctcatttcaatgtaataatgtccttaagaaatatatttcggcagccgggggagtccgagaggaagcggaggcgcgagctggaggcggcggctcccgtcggcctccggcaggactgagcgctgggaagccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagccctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaaaggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctgtgaaaatatcatggaataatagggattttagggtggatactttattttcttttatatttctatatgttgccttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttagttgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggtggactgataatatttaaaaaataattgtgtttgaccccaaatgactttatacccaattctacataaaaatatacaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaggtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaacgttgcagttttttaaaataatgaaaataaatactcttggttttgctttgtgaaaaaaaaaaaaagaaatatatttctactcaaacttgctctagagcagcagaagttgttctttataaaactaattatcaagattatataaatgagagatacaattgctcaatgtgcatctttctttctaattcattttagttcttttaaaaacagggagaggcatgcagattgagaactcttcaaaagacattgttcctttctgtatataatttacaaccttttcattatattcccaacatttttatcactcatgtgatatgctgcaagcattttggtgagcagcacttcatgaataaaatgtatcagtgcctgtaaaatttgtaagaagaatacctcaggcatacttgaaatagagcacatttttgacacttcacacttataataattcatactccagaggcctttttcatcttgtgtatcagcaagctggaaaacctccatagccaggaagggtaaattccctatgtgccatgttcctaaaatcattgggctagggttgctcccttcccacacatgacattttcaaaagttaaaatctgctaatggcccctcaagcaaaacctttttgccttttggtgatactgtgacaccgactaagagttctcacactgtattaagtacgaaggtatatcccccagttacattactagtagtgcccaagagaggagaattgtctggcttaacttattcctagtttttgatcatctgctaaagaataataatacacgtttgcaaaataaaccatcagtgcacaaaagcttaacattatcatccaccccaaattgaactttaattggaatataatgaatacttggagtatttcttaaacatctcccacatccctaatgttttttcctaaaattccatgttttctgttatctcaacttacgattgaaagctgacctccaaagcaacacaaatactatgtataccacatattgaagtatagctgatcttgctgaagacattgataacttcctcattgcaaaaatcatcttcagttattttccatcttgttggaatacttactcaagcacttgaagctgctgagtcattcctttcattaactaaaaaaaaaatattgtgcacttatgttattccaggcagtgggaatacaataattaataataatttttaaaagagtctcaaagctcaaaggagtttacaacctagtggcaaaacagagtaattaccagataattataaatcagagtggtaatgtcataaaacagtgagaaaatattgcaataataggggctccagccccagacttcgggggttaggaaaagctcccatagggcattgcattccagttgagtctggaagaattagtcaagtcatccaggggaaggatttagggaaatggagttccagagataaatcagtatatacataatcccagaggcaagaaagaatagagaatttggggaacttcaagtagctcaggatggcgagagcttaagagtcagggccgggcgcggtggctcacacctgtaatcccagcactttgggaggcagaggagggtggctcatgaggtcaggagatcgagaccatcctggctaacatggtgaaaccccgtctctactaaaaatacaaaaaattagccaggtgtggtggcgggcgcctgtagtcccagctactcgggaggctgaggcaggagaatggcgtgaatccgggaggcggagcttgcagtgagccgagatcgcgccaccgtactccagcctgggtgacagagtgagactctgtctcaagaaaaacaatgataaactggactgtggctaaagaagagtgatcagagtagtcaaaggaattggggcaaagcagtgagagaagaggacagaggtctgaatacatttatcatgctaaagagtttggaactcatttggagaagaatggagtatcttgaaccactttcagcacagagacatgtgatcagtgtgactgcctcgtggagtactgattaaaggggtcaaaatcagaggtagaggaaaatatggggaggccattgtaggcatgagatgatggcagcttaaactagaatggttgtcagtaaagcacaaagagaagtagatggctagatttcacagctattcaggatgcagaagcaagagattttggtggtgtttagtggtctcctgaatgtgagtagtaacagagaggaaagaagtaaaggatgagcctcaggtttcttcatagagaccctcatgttcaagctaagttgcccagaaggcagttggatatgtaggtccagagctcaggagaaagaactagtttggaaggtaggtctactctggtttttattctacctctctggccactgcttctttgaacttgttttatttgacacacagatatagaccttatttctaattattccatcctcatacatattctctttcactctacacactcttccccatggatttcacgtacacactcagtgttaacgaccagcaatgtttgggttcctcacaaaaccactgtatttgggagatgatcctgggaaacaccaaaagaggagtcgaaaagtaatatagggaagggaaagtagcctataaagggtgaatttccaagcaagttaccactgggggtaaagagagctaaaactcactggggaagtctggtaaactctgcagaagacatgcctcagagttatccaacttgataggtgagggagtttatgtattaatacaccaatttcagtcagccattggtcaatggctatcagcctgcctcctccaggtacatgagtacatgggtagagaaggctgtgacactacgaaaaatatttagtcataaaaatgcaattgcaagtctgccctatgcagataaagcccatacacacataggtaggacaattacagaatctgttacaacatatgtgcacaactcccaaatctataccttcagcaaaagtttaatattgaaagtcaggttccactgtgaaactataaagtgccatctaaaatgagctgttgactaatgggaccaagaagagagaagtgaaaaccaaaatatggaaccaagcaaacataagagaaccagagaggtaaaagtaaagattaaacattgagagtacaggagatggaaacggcctagctacacaaagtgaattctaaggaccagtagtatcagcatcacttgagagagtattagaaatacagacctactgaattacaagccacagaagcaagatctccagttcttacgtatgcacattaaagcttaagaaacgcttttccttcttctttagagcttgtgtcaccataatgaagacttttaaaatgcattcctaggtgcttatatttgggtgggtgcccatatccattgcctgcaatccctaatcctcttaaatagcacccagatccactaaactctttaagccaaaaatctagactcctgtctctattacccaccattgacaatctctatgattctctgccaatgccacagtgtaggtctgtatcctttacaaaagataattgcaataactttttcactggtatcattgacttctgggtcttcctgccccaacttcacctccaaaatgacacagagcaattcttaaagtacaaactaccatactgttcctcacttaaataatagagtggttatccaacaactttgagacaaattcctaactacttagtctagtaccatgagctcctccatgatctggtatctgcttaccttcttgcaaatatactggcctagtatagttactgtaatttgagcaataaatttagtgctaaaattcctgtcaatcaactcataaagggcatgagggttacataatctttatctttaaaagtctggtgctttaaaattttcatttgctactctggacttaacagcaggttaaaaggccataaaagggccctctctctaagtatgatgtatcctgggttgtttccatgctccagcccataagctagtgcaaggatggtaatcctctgttaaaaacctgaattgttatgttcaagactgtcccttaatttcctgatatcctttatctggcatacagacaacagttgctctttttcttgaacacggaagtcataaatcagtcctgtcccttttcacacctagccccagccaggaactttgtcaaaggcaggagccatgagaacccatccagaataccttagtctgttttgcactgctatgaaagaatacctgggagtgggtcatttattaagaacagaaatttatttctcacagttctggaggcagtgaagtccaagatcaaggtgccaccatctgatgtaggctttcttgctgcatgctcacatggcaaaaggggtaagggtaagacaggagtgaactctatgccttcacatagcagaagagcagaagggggagaaccaattcctgtaagtcttttttaatagtagcattaatccataaatgaggccagagcccccacaatctaaacacctcctattaggccccatctctcaaaactgttgcattggatattaagtttcccacacataaattgtgggggccacattcaaaccatagcaccaaaaaggagggcaaatcagacaattaccattttatgatcaaatttttaaagagatgaaggtatttctggtattcaattttggatgactttcttacctgagccatgatataaggaaaatcaaataacattatgtacaatatctttaaaaggatttttcaacaataaatacattgtttgtatattttctttttaaaaaatagctttgttgaggtataattgatgttcaaaaattcgcatattttattggtgagtttgggcatatgcatacacatatgtgataccatcactacaatcaaggcaataaacatttccatcacttctaaaagtttacttgtgcccctgtggttgtgtgtgtgtgtgcatgtgtgtgtatgtgtgtgataaaaacacttaatatgagatctacccctcaacaactttttaagttcacaataccatattgttaaatatgcataggcaacaaatcaaaaatagacaattaggactacagcaaactaaaaagcaaagcgaaggaaataatcaacagagtgaaaaggtgaatatggaatgcaagaaaacatttgcaaaccatttatctgatagaaagttaatatccaaaatatataatgaactcctataatttaacagtctacaaaagcccaattttaaaacggacaaaggacttgagtagacattttttcattaaaaatcatataaatggccaccaggtgaatgaaaaggcatcaaacatcacaaatcatcaggaaagcgaaaataaaaaccacaatgagatatcacctcacacctcgtatcatagctattatcagaaaaacaaaagataagcgttggccagaatgtagagaaatagaaacttttcttcactgttggtgggaatgtaaaatggtgtagccattatggaaaaaaagtatggaagtttctaaaaaataaaaactagaacatatgatcctgcaatccaacttctggacatatgtccaaaagaatcaaaatcaggattttgaagcaatacctgcactcccaagtttattgcagcattatttacaatagtcaagatatggaaacaatctaaatgtttgtcagataaatggataaataaaatgtagtatatacatacatacaatggaatattattcagcctttaaaaagaaggaaatttaaccacaacacagatgaacctgcaggacgttatgctaagtgaaataagccagtcatagatgtacagatacacatgattccatttaaacaaactatcaaaaatagtcaaactcacagtagcagagaatagaatggtggtttccagggactgtggggagtaagaaaaagggagttgttgttcgatgggtttaaattctaattatgcaggatgaataagttctagcgatctgttgtatattatgtttgtatttacatttttaaaaccatagataaaggttaagggcatgatacttttgcaaccttaaataaaagcaactggactggaattggaaggcttggtttgcattccagattgcaatttgttgccagtaggaaccaaagcaagttaatctattaatgtcagtttcctcacacataaaatgtggataaaaatactcagtctaaatgttagtatgagaattgaactagccaacagatatgaaggcatctagaacagtgcccaacatacaataagcacaaaataaatattaatgtcttctttgtattcctcacacatcaaatattcatcagttaggatatttttcaggagtagaagttaattcccataataaattcaccatttagaaaaacaaagacaaaaagcacagaactctgcaatttctagaactacaacatggctaatgtgaaattgctcttgcaataacatctagcactgctcaacaaagattaaacacttaaaactatgtagtcagttcacaagaaaaaaataaatttttatataccagaaatgtggatttcaaagtcaaagtattgtaagtaaactagaaatcttacaaattctcaaagcaaaattctcactagttaatatagcagccaccccagggattgaaattaaaaataaaagtatatattgttttgttttatatttataatcaagtttattgagatataatttaaatataattataattatacatgatttattatatataaatatacaatttaccatataattataattatataatatataatatattattattatataatttataattgagatattgtataattataattatatgataaattatatataaattatggtacaccattatttatatataaattttggtgtgccatccaatgtattttggtaaatgtacacaccagctgccatcacattcaagacatagaatatttccaaattcccaaaaagtgcccatctgcccctacccgatcaattcctcttcccattcctagcccagacaaccaccgatctactttttatcactacaacctagctttgccatttctagaattacataaatggagtcatacagcatatctggcttattttgcttttgtgtctggcttctttcactcagcatatgtttttaaattcattaatcaagaatgcatcagtagtccattctttttattgctgagtaatattccattgtaggaatatacaatactttatgtatccattcaccagttgatgaacatttgggttgttcccattttttatctattacacataaagttttttttataaagctagttgtttttatttatcttagaaagaataccaaggaatgggattgctgagttgtatgataagcatacatttacctttttaagaaacggctagactgttttctaaagcagttatatcatttcatgttgtactagcaatgagtgagacttccagttgcttcatatctttatcaacctttgatactgtcagccttttgaattttagccattctgaagtagatgtgactttaatttgcatttccctaatgagtaatgaatgctgttgagcatcttttcataggccatttatgtatctccttttgtaaagtgtctgttcaaatattttgtctgttttttacactgggctgtttagcttttattattgatttgcaatattttcttaaatattcttgatgtggaactttggttttaatctgtaaaaaagatataaaatgaaggtttgtataagtgcaagtcaagaatttggtgttgagacattcttcataaaaccagaacctttgagaagggctgtatctctagttaaaaccctcaccaccatctctggaaaatggcaacaaaaaaaaaattgcctcagcttttcgtctctaaatttaaaaaacaaaaagtctcctgagaaaatgcaacctcaagatagtgtaacacatggattttgaatccaaatgtgccctccctagtgatggtggattttccaagttgaaacagtaacaaaattagctccgagccggtaatatccttagggtgactggcagaagcaaccagaaaaccaccatttatatgtttcaatagcccaggcctattattatttcccccataaagaaatccccactaaagatgttgacataattaggccgggcgtggtggtgcacgcctgcaatcccagcactttgggaggctgaggtgggtgggtcacctgagctcaggagttcgagaccagtctgaccaacatagtgaaaccctgtctctactaaatacaaaaaattagccaggcatggcagcgcatgcctgtaatctcagctacttgggaggctgaggcaggggccattgcactccagcagccttggcaacaagagcaaaactctgtctcaaaaaaaaaaaaaaaaaaaagttgagataattaaaaaaaaaagaacgaagaaatgatctatcttgaaaagcttcatatgacacacaaaagtaggaatagaccataaaatctttgagtttatagaaaaatatttttaagtattaaaatacatattagacattataaggaaagaacaatattctatgaaaaaataaaagacatatttgaaagtaaactgaatatgacttctataatgaaaaatatagttttgaggtctgtgagctgcctgattaggaggggaatttggagggtctttaaaatccaatttaatgttgccattctttgattctaagagtgaccaccgttttcaga

SEQ ID NO: 826 - DNA, 29945 bp, Homo sapiens
tgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaa

SEQ ID NO: 827 - DNA, 219082 bp, Homo sapiens
ctgagatggtaaccctggtttaactagttggtaattccagtttgcttaagcattgagattgctatgttgagacagctggttatccttaaatattataatttacttttttattttaatagaaccccagatttttagctgggcacatgtgtgctcagaatcaagattatatttcctagccttctttatagccaagtttgaccatacgaatatgtttttgtcaaagggatataagaagtgatgtacaacatccagaagctatctctgaagagagaaaaagcctatctttattctttcccttttttcccttctttgtggctggagtatagataagatggctagaactggagtagtcatcattggcaatgaggtgacctatactagagcaacaagatagaaggagcctgggtccttgacatgatgaaactgccgtaccaatctgactgcctttctctagacttttacatcaggggaagtacatttttccttggtcagctacttttgcaggtgaatctcatcctgattaatttcgcacaaaatgctcagctcccttgaaatgaaaacattgtgtcttagttgttaagtttattttctacccatggaacatgaagaacaaacacagggtttgcatcagttatctctctctactataatgctgtgtaacaaccacaaaatctctgtgatgcaactcaaatttcctccatgtgtccctcatcctccagcaggatagcccaggtatggtctcatggcaatgatagaggaaaaagagaacaagtactttttcaagcctctagttgtctcatgtttgttaacatcacattttccaaaataagacatgtgcctggactcagaatcaaggggtaggaaaatatattgtctcttgataggaggaactgcagtcaattggcaaatggcatggatacagggaagggtaaagaatttacgtcattatttcaatcattctaaccttcatattaaagttttaaaaataagcttagaattaaattttgggataggttttcataataattgtaatactgtatccatttggtatttaatggttttgcaatatcagagagaatttggcatgttagagaatatgcaagacttagattatgattccaattccaaatgtaagattttgtcattgattttagtcttttgaatgatatttggaaagtgtgagataaatttactaagttagcaaacagtactgaaggcctaagagaagttcaggttcactaggtctcaagttgaatttttagattttctagcattaagttttgtgaaaatatcttatttggtactcttctgaaatgttagcccttctaaaaggctttccctgaccattcaataaaaagtgactatatcactttaccttctcttctatagagcatttatcagtatctggaatgataccatatacttgtttattacctactttacccactaaaatacagtctccacaaaggcaagcattttgttttgcttgctgctgtatccagaacacttataaaggagcttgatatatagtaggtgctccaaaatttgctgaatgactgaataaagctttggttttaggtcatggctttgaaatacttaaagagaaattttaatataataaatttatgaatgtaattcaaatcctgtaaattaattaactgaattataaacagggctaatagtttgaggagttcagtctgctcaatttgagttgactaaatattaattaaaggttttctagtcagtggctaatagtttaaggagttcagtctgctcaatttgagttgactaaatattaattaaaggttttctagtcagtcactgttaaaatttagtgtgtatagaaatagaataataggatttgcaaactggtcttaaagacttataggaaagctagcttgttaaatgttgttttagtaattgaatattatttttaaaagtaaattttaagaattaaaaaaataaagtaacaatactgattatttctgaattaaaaaactgtgcaaggacttaggaatcctcatactgtccacacgaagtctgtatgatgcacatatcgaggggcatggagcagtaaacagctgagtcccagagaaggagcgaggagacattatttactgggattgctgtcactgtggagaatgatgatggtgtaacacaggaaatgtaggggttggggtaaaatggagggggagccatctttactttaaagagatgggtaaaccttttcatgtcttcaaaactgaaattgacttctgtctctccaaaaaccccatgatgagtcaagacagagttgaggagagagaataaaggaatatttaggaggaattatggtagcattccttttataaatcaattgaaaaggagaacaaataaacaattttcaaaggcttaatgataaaggtacccactgagggtgttggaatagcagtaatggcagtcacaatgactctggttttcatcagagcagaatctcctgtttctggctttaattatctaccattttggctatattgtcacataacaaccacctcaaaaactagtggctaaaaataattattttattttgttcacaattttgtgggcaaagaatttgagaagggctcagcaggacaaatttctggttcagattgtatgagctagaaaagatgggactgcgaggttagcttccaagaagaatttttttacccacatgcctagtaccttagtgctctttgatctctcactctctacatgttgtatcattcttcagagcctctacgtgtagcttgagattctcacagcatgatggtctcggggtagttgcccttcttacaggatggctggcttccaagaggcagaaagtaggagttgccagggcagttatggcctacaagtggaactggagtagcattacttccactgactcagttggtcaaagcactcacaaggcctgcacagatttaaaggaggtggcgatatagactccactttttaatggtgcagtgtcaatgtcacattgagtgaaaatggcagagtaaggacctctgaaaattcactcctacataaaaataataagaacactgaaaaatggtcagaatcaacattttcagaactctggaaattaaccaaagggttgcgctaatctggggagcatttattcaagaacaatggctaaaactcattaagaactgcaaaaatttctggcattttaactttccatattcccatccccctctcttcagccccatggtagccttaaaaaaaccaatagcctacaatcagtgaaaaccagcatcctgacagccaccggaaagggtagaacagagttgaagcactctgcaacattccagagaattatcattatttgacctgtctgtggttccctgaaagatcactctcaaagctgtctttattttacctgacttggagcttgctcagtatgtaaagctttttcttcagagaatttgtcaaaaacaacagaggcaattgttgaaccttgaagctgcctgaggtggtacatagattgcaattgaggtagacaataggctaaacaaaaaacttaaatggaataactggaaaatgaaatgtccatgggggcttcaaaaattgtaacatgtttctggaaatctggagggccatgcacatatatagggctctttgcatgctcaagaaaaacctgagaagtctctaactttttatgtctgactaacctcaaggtgctctgcaaataggaagtaaaggctaagttggagttgtaaactctctgcctgagtgttgagggggtgcctcaacatgcactcagagaccctcaacaaagactaggagacttattggtttcagacatgtaaggaaatctcaatctaatcattagctaacagagtagagactccactggccacacatgacaagaaatacagatttcactgaattagtttagaaaagtcactaagcaatcaagaaaccctggggaggtaggagaaattgatttccagagttaccacattatattattttaaatgtccacttttaaattacgaggcatgcaaaagaacaagaaactatggcgtatccacaggaaaaatgagtcaatagaaactatctttgaggaagaccagttgctgaggttactgacttgaaatcagctattttataaagagctgaaggaaaccacatctaaagaactaaggaaaagcatagaacaatgtcttacaagtacagaacagaacatcaataaagagataaagtatttaaaaagaaacttgcaagttgaaaagttcaataactaaaataaaactttcagtcgaggtgttcaacagatttgggcaagcagaagaaagaattagtggacttgataatagactgattgagataatctaatctgaggagcagaaaaaaaaaagaaaaacatagcctaagagacctgtgggacaccagcaggcatactagcatattcataatgggagtcctaataggagaagagagagaaaagacagcagaaataatatttcttttttttttcttttttttttttgagatggagtcttgatctgttgcccaggctggagtgcagtggcacgatcttggcttatgcaacctctgcttcctgagttcaagtgattctcctgcctcaacctcccaagttgctgggactacaggcacccgccaccacaccctgttaatttttgtatttttagtagaggtggggtttcaccatgttggccaggctggtctcaaactcctgacctcaagtgatcagcctgccttggcctccctaagtgttgggattacaggcgtgagccacagcgcctggccgaatgcttcaaaataaaatggccaaaaacttcacaaattcaataaaagatatgaatctacacattcgagaatccctatgaattccaagttggataaactcaaagagatctacatttagacaaacaataatcaaactgtcatcatgaagagaaacctttgaaagcagcaatatcatcacagatcaggaatctccaataagattagcagcaggtttcttatcacaaaccaaggaggacagaaggcaaagtgttgatatatttgaagtgctaaaagaaagagactgtcaactaagacactaagacttctatatctatcaaaactatcattcaaaagtgaaggagaatttaaggcattccggataaataaaaacagacagaatttgtcactagcagacctgtccaacaggaaaaattagagagtctttcaggctaaaatgaaaggacaccaaactgctactcaaaaccatgtaaagaaataaagaacccaggtaaagataactacatagttaaacatatataaagtatagcataaatttattttttctttttaactgttttttctcctctttgatttaaaaggcaatttcataaggcaataattgtatgtctgtattgatgggcatgcaatgtttaatgctttaatttttatgacaatatctacacaaataagggtgcatagaatggagataaattggagcagtgttttttgtattatgttgtaattaaattggcatgaatttgagccagtttgttttaagttaagatgttaattgtcattgccagggcaactactaagaaaatatcttaaaaaaatacagtaaaagaaatgacaagagaattaaaaggtacaccagaaagtatctttttaacacaaaataaggcaataatggatgactaaaagaacaaaaaggcataaggcatataaaaaataaatttcaaaatggcagacacaaatcctgcttgacgagtaatcgcattaaatataagtgaattaaacagcataacggatttttaaaaatgatacaactgtatcctggccacaagagacatactttagattcaaagtcacaaatatgtcgaaagttaaaaatggaaaaagatataccatgcaaatagtaatcaaaagagagctggagaggctattctaatatcagacaaaatagactttaagacaaaattgttgctagagataaaggaatacatttaataataaacagtgtcaatccaacaagaagatatgaaaattataaacatatatgcacccacgaagagaacatcaaaacacatgaagcaaaaattgacagaaaaacgtatgtgatgggagatattgttgtggccatctttagaaaatataatctgccacatgcactagaaaaattacactatgtttagtattcacattatcttgttctagtaactctcatttagatatctgttatagaaattaatggactgattatccctcaaatctcaagatcatttattaagacttcacattagcatccagaggctgaggaggctgaggagttcatatgatacagctcatataattttaaaaagaaagtatccttttatctaggcttttcatcttttatatataagcctgccttcccctagaggtctagatataatgtattgatagccagctattgaggactgtaggtgattcactcacctccgacttctagaggcaaattcttatggtcaaccaggaagctgaggcttccttcattgaacatttagaatgcggttattcacccaacagttgatatagtccatgtcatactcataaattgttcccacaaggggacagtatatatcaaaacagactaggtgcagtggctcacgcctgtaatcccaacactttgggaggcagaggagagcagatcacctgaggttgggagttcgagaccagcctggccaacatggagaaaccctgtctctcttaaaaaaaaaaaaatacaaaaattagctgggcgtagtggcaagtgactgtaatctcaggtacttgggaggctgaggcaggagaattgcttgaacccgggaggcgaaggttgcagtgaaccgagatcatgccactgcactccagcctgggcaacagagcaagactgtctcaaaaaaaaaaaaaaaaagtacgttgacagatgtggtaggtacattttctagaaattctccccatgattccaggtcccaatccccaggacctgtgaaggtaattgggtatgaaatttgtgattgagtcttgactcatacattgagtcttgttacagctgtgttacttcataacacagttgtaaaggtaagctatcagggtatcgagtagcctaatctaaacacatgggcccttaaagtagagaattttctccaactgctggcagaagaagagggcagacgggaatgtcagagacattcaaaacgcaaggcggctttgattcaccaccattcctagctttgaagatgaaggggaccacatgaaaactgtggatggcctctacaagctgagggaggctgtcagctgccagtcagaaaaggaagggggacctcagtcctacaactgcaagaaatgaagtctgccaacaacttaaatgaactttaggttgaagcagattctcccccaaagcctcttgaaaagagctcagccagccaacatcttgtgaaactcagcagaaaatctagccacgtccacccagaattatggcctacacaactgtgaggtactaaatgagtgttcttacaaactgcttagtttatggtaatttgttacacatccatggcaaactaatacagtggatcaacagagtaccaatgtggaatccccattaattcttatctttcttcttcccatgatcacatgagtgagctacacagatgttgtatataaagcaaacatgaagatgtctatgacaagcgatgggcattgcaaattcagggatttccccaacacagacagaaagtctatggatttaatgattgttgcatatgtgatacaggttttattattgcttcaaaacattatgtttcattatggaagggggttgggctgtaatcctggctggaggatatatgaactaagaaaatattactacatagatgattgggggaatatgtgagaaatgaatacatgatatatgtgcacaatttcaactttatttttactgcagcagataatgataagatgtattttcactgagcctgcagaatttaaagggcttgtccagggagatttttgaatgtacaggtttggaaagttttcagaaaatgaatagagaaacttatctatggatgtcctttattgtccaatcttccgtcattgaaaataaccctttgtcaggcactggtgataactatcaaattgttagtcattctgtagccccactaaagtagaaaatctttctgctctcagatgctgcatctctctaatagtagcagcctaaccttgcaccttgacatgaatcaacttgtggctggctttaaaatacttaagcaaatgcttatttgcattgaatttttcatttctttatactatatctccttgttgttcataaagtcacatgctttaaaactttggtttgaatggaaaagaaacttaaagatacaaagagctgaggatgatccctaacccacaaaataagaattttccatctctgccattcattgtgtcattttgtcatattctctctctctgtctctctttctctctctcacccctcactcctttcctccttccttccctcttcagcctcctcccttgcccctgttttaaatatgtattcctatcccattgtaatgccaaaatgctttagactgagcacaaccctcacttgagctttttcccttttatcagctaagcttggaatttttcaaaggttagatatgattacttactgtgaaatactaagacagaccttctggcaattgttctttcatccaaatgaagggttgaactttcaaacagttcatttactaggtactgcacctattcaaatgagcctgcattaatacaaaaatttttgaaacaaagttgttgagattgtttgaaaaatggtcaggcgcggtggctcacacctgtaatcccagcactttgggaggccgaggcaggcagatcacctgaggtcgggagtttgagaccagactgaccaacatggagaaaccacgtctctactaaaaatacccaaaaaactagctgggcgtggtggcaggtgcttgtaatctcagctactcgggaggctgaggcaggagaatcacttgaacttggaaggcagaggttgcggtgagctgagatcgcaccattgcactccagcctaggcaacaagcaaaactccttctaaaaaaaaaagaaaaaaaaagaaaaaaaaagaaagataacccattccacaagaagaagatcagtttccttacaagcagattattgttttagtcacaaatttatacctaggcttaacttctttctatgttttagctttatctttattcttctatccttcctctgctgtgctggtgctgtggtagaaattatctagaggaagacctgtatagggcagcggcagggcctggcttaagatgagacctggagagtattgctaataattacaatgggaaatggaaaggctatcttagaatattttatgtgctattcattgtcatcctaggtgcactggctgagcgccatcaattatacacattaatgcaattagtcaagatacagaagcttgtattccaaatgaaaatttcctacatctgaggcatctgtgtaaaaggtaagatgtgctacatttccaaaactgtgtctaaaattctatttacaatgggttacgaactcaatacccctagaggcaaggcaggtagacaatgaggaaatggtgataactatgataaattgggtgtgtctgccctatctttttgtcttgttttgttttgagatagagtctccctctgttgcccaggctggagtgcagtggcgcaatcttggctcgctgcaaactctgcctgccaggttcaagcgattctcctgcctcagcctccttgaatagctgggactacaggcgtgcgccaccatgcccagctaatttttttttgtatttttagtagagatgaggtttcaccatgttggccaggcaggtctcgaactcttgacctaaggtgatccgcccgcctcagcctcctaaaatgctgggattataggtgtgagccacctcacctggctgtgtccaccctatcttaaggagagagccattctccaacctctgccttttgttgccacacagattctgagaccactgttgcctgatcctgattcttgaaagaggaagcagaaacatggattattttatttgaattcccctatatgtaaatgcttattcctttttcatacaaatgaaacataatagacaagacaaacaaaacactcctataggctggatttagccactggatcattaatatcaaggtgaccattaaaatcaagggttcccatgggagacggaacttgcagtgagccgagatcgcgccactgcactccagcctgggcgacagagcaagactccatctaaaaaaaaaaaaaaaaaatcaagggttcccagtgatctcgtttcccacattggttctctctcttttactaggtatacatgtttagtatacagacaagtattttcagttagggataggtgtgtatgtatatatatatatatatatatgtatataatttgtgcaaggatgttatcttttgcatgaaaatcaatctaggtgtatgaactgggcctgtaaaatttattggaagtcagtaataaataaatatgaccactgtgtttattttactgtcttctgattaaattttgtgttgactctggggtaaattatctgatatgctgcaatgggatatttccaggagacttatttggaaaacctgattagaacccagtagagggtaaatgacagagtccagtgaaagaaatcattcttggaggcagttgttttcactcttcatgactatttctagaaataagctttagggaaggatgttgcctaactagggcttactgtagagggattttcctgttcctactggcaatttatgtagttactatgaatcagtggtagaattagatgcatttgttgactgaatcaattggagtttctgtttgttttaaatcaggcatacaatatatcatgccttacaatgacaattaaatacagatttagaatcactggattattaaatgtaagtgtcataaggacaagtaaaatgcatcgacttcagggattccctgccagaaagtcatgcttactggattcattgcacagccgtatctgggacccgctccccaccacatccagcttgtgcagggacaatcccagaaagaaatgtaaagtggctgattacaattttggagtgtatttcctgagaccccttacccctttctgaccttgtaattcatcattgacgttaacataataatgatgattgaggtaataaagcctagatctttaacatatgaagttcagagaccatagcagaggctgctggtgccctaccatcccttccgtgttcacccggacatgcaaaaggctgcttgctgcaaaaacctgctactattactctctgtctgagggctttttttcccctgtggtcaaagaggcaagctctccttgtgtctaggataaggtccccagaagtagcctttaaccaatgactgatgggaagttgatggataaaaacaccccaacttctttgactgtcaaattatgtatctctaagacgtgactttgcatttccagcaagttcccatgtgatgcttatcctgctggccagggactacactgtgagagccactgtactaaagacattgaaccacatcaaggactgaagcattttaggatttgatcacgtgttcttttcatagaataattttctaaaatctatttttacttatgcctcctacccacggaagtcaattacttgaaataacttgtagggaaaaaaaaacttttcatttatattttatcttagccattcccttactgtgattttgattttcttgctgtcagggttaaccgttttggtaggcctaaactaccattaaaagtcgttagtggtataaattttctaataattcagaaaaattctattgtattatttgtgaatctaattgagttaatgagttttattctacaaataatatttataataataggtctttcataaacataagcacaaattctttcattagtacatttttcctgtatgtcaacattttaaataaagtacatatgtgaattttatggcattttttcatttgtgatcatatatttctttaagggaaatagcacatcacttcagattcctgttaattttacctgctgtcatctcctacttaaatgagtcatgtcaagtattacgtgctgcttctcctgacaagtacctgaaagttggagcaattttcacacactctgtcctattcttctgtcatagttcttcaatgcattatgggcaggaaatgactttgactgatgagaagagttagtgggaggatgttcaaatcaaatggcacttatccttgccctccacccccttatctctaagaactccccacagatggcttacgttgtcctgggctggtttatggtatagcaccattctctgctaagctcttgaacaccagctcatctgcttaattccaggtcttctctatccgttctgggctctcctatcctcttccccattgctgtgcttcacttctcccttttttcaaataaaactaacatatggcttttgtgtgtggccgatttctaaatcttggaaataacagggaagggaaaaaatggtgacaacccagcccagtaccacaaacttacaacagaatatcatgccaccatgttctcagttctttagctatgcccgatcacagagaatttctcctcaggcctccatattgcttatatctttgcctcttcctctttctgtcccctgctttcatcccttcctcccttcttgctggcctcccttctggccaccttagtctctcttactctgtttcatggtgtaatttggctctcattcatttaaaatttgagcaagggtcctcacatttctctatgaacaagtcagtcaaggcccatcatcaaagtatttttctaaacaaaagagctatctacctctgagaagatttgaatcattcccctagagaggatgaagtgaccatagtcagtattgttttaagtaccattttaaattctcactacatttgttaaagggaagacaatagggaggcttactgctgagagtatttttgtgaattgacacaggtttggaaaggaaaactaaggtgaattaggaagtgcattgctggcttatgttaaagaagaaaatgtttaaggactcttgctaaagatggtaatgaaggctttatttggggagactattggctataggtagaggaaccactgcaatgaggtcttgaaatgggggaaggagactgggcttaactctgactccaataaggccaagtggggatttacaaccaaggagcaggttgagggtcagtgggtggaaaattactaaaaggaaacctcagggtaagggtgactcttactagaccaactcaacataactcctgctgaaggctggccagggtgatttgatatcgaggatgggggatgagaaatttgattatacaaagtgtgggggattttcagtaaactaacttagccccattcttgcttatacttgattctacagggacaaagaggggagcccaaggtcggaactaggttaaaggagggagtctttgttacttagaagtcagattcctcgttttagctctgcttctgtctggcagtgtggtctttaacaagccacttaatgtctcccagcctgtgtttcatttgtaaatcgagagaatttgttctgtgtctttcaagctgaagcataagcctaaacaaaacaaacaaaaattcaccatggctcctgttgaagcaagggaggagtccagacctacccctttatttttttctctcccatggcctcatcggcagagttctgaacacactaatctagatgattttcataaacaattgttccctgcttttctggagctttttatcaaaattcagtttactataaatgctccttatatgtcaagcagaagcctctcaggtggaagcctgagaaaggaacttcccatggcctgacatagctgaggaattttggagcatagtcgtttcatgtttatttatggattgtttatggccctaggctaagctataaccaaatcttcttactcaccatcctatgtattcttaatatttaaaagtctatcacaggtctggtctgttttggaaatgatgtacctgttgaaaaagatttttttttttctgggaaaagagtctgggggcattttgattgagatttgacatttggcaataattgatgagtatgttttttatcttaaaatgcctgtgtaattgataatatacttaaagaaatctattacattagcaggtgattccatgaagaaggcagaaatcacttaaacctctatagcaggaatttgtgacataccacaaaactgccccaaccccttgggaacttgatttccattcacttgtggagatgagtcccctgcacttgccagacacccatgccaagtgggcagtggggcaaaaaatggagggtcattccatgaatgcgggcacaactgaaagtaagttaacacctccagagacaatccttagccaatggtgagtaggagtaggtagaataatgccccagccactcctacctttgatggtataattttgaagagcattgtgtgcagttcttcacagtatccttaaggagactgagtctcatttttctatagaagtagaatacatttgattttttcttcctttctctgtctcactttctctatctctcacttttgcatcctgggattacctcataaatacttatctgcctccaagtccttgcctcagggtctacttttgggggaacccaaattaaactaacttccaaagctggtacaacttcctatactaataattaaatagatggtcgactgatttcaaagcaaagcttttgcattctgcaactactcttaactttacatatatgttattgtttcaataaattgtactgtgttcttgagaatacaatctgaagcaaagcagagatataggtatagtaattctatttttacaagaattataaattgagataactgtgaattatatgattttagaatttaccttttcagctttcatggagcaagtttgttgagggtttttaattcagtaagaagaaaaatatgatgtggttttatttttttctgttaactgtcccccaactgtgtcaacacccctttcccaaagatttgatactaactttatgacatcttagtcagatttcatgactctcatcttactttgtattcctggaaataatcattttatttcagaaaattattttctcctcagtgggatgggagggaataatcagtctccatgaacagcgcccaaaagactggtgacttttccaccttctgcatagttctccagtcttgatgggaaagcagggtggtgttggttgatgataagggtgacactgtcctggcaccttccaatagacctgatctccactgttggtggctcactgaagactcaatgaacttagagcgtgtcttcaaattgggccttaaaattccatctgcatcctgttgtggtatgtttacttaatcttaacagtaaacaaatttgtacttcctgagttcgcatcagcaagtctgttgttagaagtcagtttgagttttagaaatttattaggtatgatttactcatgagtaaatgagagttggctaaaacaggtggaatgacaaaatcagaagcatcaaaaatcatggctacagtcaccttatgactatccagaattagaaggctctatgcagagatttgagaaatggcaacaaatgaaagtgccagcatctgtagttcagcatttgtagctgtggagtatgtagattcacttttacctgacagtcctctgcaagaaccattttaaaatgcttggaattgtatgttaataattatacaatgttctagattgcaacatggggatctgctattgttcatgaaaacttttatttcttgttctttttacctgggtttctatttcaatttataccttgcattaaaaagaataacattgaaaaatataaaccagagacataggaaaaccaacggaagtgctttaaattacttctctttaatcacttttgtatccagctgcttttatgtgtggaacctattattttacagagtatttcaatattctttatgattgaaaaagaatgacaaaatggtatatgcttttggtaaggtgctttggctatactacagtctttgatactacttggcactatttctaagcctgcatagattcttttaccacaaaaagaatatgtaaatagattcataaaattcatcatgagtttcaagctccatttggaatagaagctgaatatgcacatcctttggaaattctaattcttggaactggatttttcattggaatcatgcttttgtgttaccatgtaattaattcttctttggacatgggtgacaatttatttgatagaaactattgatgcccatcgtggttatgatattcctctcaaacctttaaatctcatccttttctatgctggttctcagcatcatgatttacaccacataaacttcatcagaaagtatgcttctacattttcatggtggaatacaatttttcgaacacactttcagtttaatgtttatagtgaaaatatgaagaagtttgagaaaaagctgaataaatatctcatataaacctttctgaagatatacattttcctgaattgaaactagtagctaacattgcttctggggagcagaaataagcatgtgtcttggttgctaagtgataaaaggaatattgataacctctaattatcttcctagtggagactttttctactttacacacagattccgtatatgtaggaatacatggataataagtatttcctgcaaaactggtcccctcttcatcacctcattgccttactctctctcttgccccactttcttctctccctcatttcctcctctccttaaactttcctctttcattcactgtcccttatttctccctcacttctgaggggccaaattgattgtcttcatattataaggctcacccttttcttgataatctctggtcaatcagcttcattcagtgattgctttgtgaacattcctgtgcatcataagacatttcctatttccatctgatatggtttggctctgtgtccctaccaaaatctcacctcaaattgtaatccccacgtgtcggaggagggacatggtgggaggtgattggatcatggcggaagtttccctcatgctgttctcgtgatattgagtgagttctcacaagaactgatggtttaaaaggatgtggctttctttgctctctctatctctcctgccaccatgtaagacatgccttgcttccccttcaccctctgccatgattgtaagtttcctgatgcctccccagccatgcggaactgtgagtcatgtaaacctctttcctttataaattacacagtctcaggtacttctttatagcagtgtgaaaatggactaatacaccatcagaaaactgatatcattttagctaagatttacatctttttgggcgctgtgttctggccactctttctctgttgggtaaaagaaatagaaactgcatagatttggcagacagactttggtgtagatcctaattttcccactttgtaagtttggctaagctagttatttttttccatattcagtttcctcacattaagtgaggctaataatagccaccttgaaggatttttgtgagattaaataagatgaactatttgattatttgttaacatcttaatttgaaaacattttctcctgtgcctccccaactccatttcatatttcttttcctgatgtttttatacatttccaaacaaaaccaaagtaccaaatgactcagtcaatttaagcccaaatacacagagttccaaatcttcttcatagcttcattgtttcagtatgagaatatttcttaagtgggcaaattctactccaggaggcttcagaatggtcaggaactttttttcttattttcttacacttatttcatttagatcctgcataattcctcccaagtttatcctattaccaagcagtctaatggacaataatgacagggaaccttatataacagagtagtaaaggttaatgacaacaagaggtataacatgagctgcttttatttactaggaatattagttgttctagaatttaaagtccaaaagcatcactggaatcaattttctaagcattagttttatgttttatttttaaaaataaaaaagcatatatcatttcaaggaatattattatatgttattataaaattatatattatattatgaaatcatttacataatttttgcttaaattattttttgcaactttattgaagtatagatgatggttagaatttatatatttacatatatttttatatatatttagagtatacaacttgatgatttgatatatgtatacattgccactttccccatctgccaccacctccccgcctcagcctctggtaactaccaagctactttctatgttcaactgttttagattccacatataagtgagatcatggatgtttgcctttctaggcctggcttatgtcacttaacataatgttctccaggttcctccatattgtcacaaatgacaggatttccttcttttttatggctgaatagtattccattttgtttatgtaccacattttttaaattcatccattgacagacacttagtttcgctattgtgaataatgctgcagtgaacataggaatacagatatctaagggggagagattttaaaacaaactgagcctcaatttgttgctatttcttttctgtatgtaaactctaaaggttcctattcaatttcagtcatgttatctgatatggtagccattcacattggaatctaaaaatcatttccaacccgtttcttctcttgtccacctctaccatggaggctgaaaaaacctgagactcactttcctattctcccctgccaatgagatataagggaagttattatggggcttcatggaaagtttgtactttctaataaaaggaacaaggtacataaatggcttgtctcagtctaatttctatgaattcctgcctttaaatgctactttgttattgtgatacttgcagctaggaagagcatcttgaaaccatgaagcaaccattcaaagaacaaaatcccatatgctaaggatggtcaaacataacagcagaaaaagcctatgtccttcatgacatgggtgagccaccaaaccaacctgacattgaggtacctccaatggtttatatcattgcagtttgtttattattgttgttgttattcatattgctattgcttgctgcccaaagcattcctcattgattaaatctggaaagagtaagctatcatgccattagtgcttccaccttaatcagcttaatttcttacacctcacaagatctgagaagaacaggtacattttgattgtggttagagggtagaacatgaaaaaaggaaaaaataaataatgttcaccataatgagggaagcttatttggcaccaaggaagacaaaaaaggaaaatatacactagttagggaaaataaaaggaaatgtagagtacatgttttgcccttttagttgcacctgggtgcccagttgaccctgggtacaacatttaaaaaaagttgtgtttaatttgtaattatatgctgtttaacattataattgcatgtgaaccatgacaaattattaattccactctagatctctcctgtcatatagacagtggtttgaatgcttaggacatggaaatcaatttcttgactggtctaaggtacacatcattagaaaagaatacctgttgcaaaaaatttttaaatgtgagtgatttgtatcctttgttgttttggactattcatgctcccagcccttttccgtattttatgaagtctttaatcaatacctatttaaatctttgaggaatgccatcatgatcaaattggaacttcaagaagtttgaaagattttctctcaatagattgagtcactgcctttcacctgttttcctacttaaggaaatataaattatgtatttaaacatcctcttgctcttagatatggtatatatgcttctgggaccctttctgttggcacctgttcctctactctacagtatttctcacttagaggaaacctaataaatgtatatctaaaagatattgctctattgtgcatatatattttatgaaataattatttgctgaaagtattttcagaagagctgttttaggtaggaagattttcaaataccatttgataacttatatgtgaattactacctttcagaaataataactgtaaagcaggatatatctttatttacttttacttttccgaaggtttgatatatgctttcagtcttcagaacctgtacttggaattctgtttataaccgagaagtatgcaatgctttcctatttaagaaactcaaaccagcgtattgcttttttggtggctttaatattggttgaaattacctttaatgtatgatgtatattcagttggttgttatagaaaatattattcattaacagttttattataaaagacagtaattgaaaatacaccaaatattgatttttgaccaaattaaataagttctttttctgagagcttttcaggctatgaaagtataaagatgtttggaaacatatcttgatatgtgttcattttaaggtatactgaagtttttcaattgttaatcagtgcagcacatgatgggtgttatccatccaacatgtaatacaattttacttttatagcaattaccgaaattgactgaagagcctgagtagaacaataatcatggaagaaattggaatatgtgtaaattgatctgatctgaagggcagaaagacttacgaggaataaaaaaaaaaaagttatggatccataaagtaaaagaatttttttttcaaagtttagttcactattatataccaaagaaaagtgccatctgactaagaagccctgttctattaaattcttactaaatatctgtttctatgtggaaataaatgctaaactccattatcttgctttcatattactaacattagatttgttaaaagatcctcggtaaataagtgaattgatttcaatggtgattttttgaatcacatgtattaatagcaagaaaaatatattatttgggattaggaacagaaaatatcaaaagcattttaataaacggtataaatatgttttatgagtttttttaaaaaaatcagtcattcattcatttactcactaagtatttactaagcatgccgtatgtgtcaggttctgccctagggtggcggattccaattaaagcatgagtaagacagtctcacctcaaaaagacagtaggagagatagactgataggtcattatactgtggtaagtacatataaatatgtacagcaaattgtgaggagcaaggaggagaaaaccataaactgggttaaggagaggcccagggattgctttctggagaggttttgaggaactacaagcagtgttgctgtagtaaaaattgtaaggcaggagtggtgagggatgagtctaaagagttagctagggccagaccttgagggtcttgcttggaagttagactttattctgtggatggtggaaacccattaaagaagttttaacaaagtggagaaggaatacaatggggagaaatggtcaaatttccttagagaaaggtcctttggtggatacatggatcatattcttgaggaggatgggctagacacaaggagaccaggcaaatctattgcagtaatccaggatcaaagatatgagggtttgaatcagagcagtggcaaaagaaatacagagggggctctgaattcaagaaatgtttggaatatagatttgtaagatctaggaattgttggaatgtaaaggtcagggtgaggagggaaaatcaaggatatctttaggcttctcttttgggtgaattcagtattactaactaaaatagagaggggagttatgtcaataagctattgttccattaaaaagtacaggaaaattaactggcttaaaacaacaataatttattcttcttcacgcttctgctacttgattgagagttaactcttctgcacttgggtttgtctagccctgggtttgtctgcacttagctccagatggtagacagggtccaatttttgctgaccttactcttgtctttattagacttatgggctagccaagaaatgttctttccatgacaaggtcaaaagcacaagaactgaagttgccaaactcctacttgagttacacctgtggttatactgaccgaagcaaatcacgtggataagcccaaagtcaaagggtagggaagtatactccatctctagtggaaggaacttcaatgtcattagcaaaggtaactggggtaaggagagggccagggattgctttctggagaggacactaagaggatggacactaggagggatgaagaatttgggccaataattcaacacccttattgttattgtgagtgatagatttgaggggaagaagactggaggttaagaggctatttcaaagatggtaaaagtccagagcagtggcagctggaaaagagagaaaatgatagattcaagaagtattcaaggcctggacattgttataacatggaggacagatttaggggaaagagtcaaggatgactctaggcttccaatttgactgactgagatatggaaagaaggatagtgggttcagtgtaggaaacattgagtctgagagagagtgacaaagaattttatcgtcaaaaccagggcacttcagagaacgtgaaagagtgctattaataattacgccagaaccaccagggtaaacatgtcttgggactgatctcaggaaaacgagtttatattcactctggagcgagttgcctttgggtaatcaaagtgaagttattgagcatcagagaaagactctgtctaaaaaataaataaattaatttaaaaaagtgaaattatttagtataatgttgatatttgagtatgaaattcagtggagagaactggtctggtgatatagacttgggagttatcattcatagtttaaagtttgaaagcatgagtctggttgaaatcatcaaaggaagcatatgcaggatgaaatgaatataatagaatgagaagatgttgctggagtagatgacagatgaggaacttgagaaggaaaagtcaacaaataagaatttgatttaagccaaagagtagaatttaatggacaaaataatcatatgagaacactcagggtcagagctggctttgagtatgactaaagttagaaattttaacaccatctttttttccctcagactctctgtttttttgttttgttttgtttttaagctgagtgactctttgaggctagagtcatgatcttaggcagttccagattcatattctattagctccaaaaccagaaaaaaaaaggagttttttccttgttatctcaaaatacaaaataaacctgagggaagactctaattggtcaggtataagtcacatgcccatccctctactaatcaccatggctagagagttggggacccccacattagtgaagatgcaggagagcagtgggggtaaaagtcagattacagcaacttgagaagtgactgagaggtggtttggatgcagcaagtacagataagcattttaataaatttattataataaatatgaagaagagacaaactatacagtagactacatgaagggcaatgcgtatgtattttagatttgtttataggctgagataaaggaatcagtgaaacttgagatattcaagttaaagaaaaaaagagaatgcttgttggaacaagatcatggagcaagtctgaggagatgagatttaggacaaaaaaatgaaagaatgtagatttgaaaagggaaaagaacatctagtcctctgaacctatgatgaggtacagctaagtgtggacatcagtaagttaatggaagggcagtatattgagagagccaaggctaagagggagggcatcagggcctgagtaatttcagaagagcattgaaaagtcattgagggcactggcttcaggaactgactgaaggtaaggaaaagaattcacaggtgattaggcttagctgatttgtggaccacgagtttgtcttctcacccagtctgtagggctgtgtgatttttctctagctgtcctggatatgggcatgaagaaggtaaattgatctagggttggtgctttgatgagttcacgtaaatggggacaagatgctctcctcaaggaaacatacagctttagaggcaaatacaaggtcttaaagataagtaagcaagaacaagaagggaactttacttatttctggcattctgacatggtaatggtagacctctctatgaaataacatttctaattgacctttgctttcaatttctgttgtgatgagaagtttataactcttggaccatgctggagtaaatcaaaacataacagatgtttcacaatttgcaaaactgatttaattgtgttttatgttgtattatatttctgatagttataactttcctccccatctttcaccacacacgtacgcacacacatacacgcacaaatggacatatagcaacatcgtgtgcaaagctcttttggtgtcactatgaagctatggtgagttaacataatcagaacataatttcaggtctctaagtttcaattccagtatgccatatgaagaaaaaatattatcaaaaatagaacaacttttatataacttttatttaatgataccaaaattcttagaggtcattgcaacaaagtcttatcaatagcaggaaatattttgcagcatactgtaaagaacactggatctttttaccactaacgagatacgagatccagggcaaatgagttttctcatatctgtaaaattagggttatggtcccttcttgtatacctcacaatgtggttataaaaaaatcagagaggatgtggcaaaaagtgttttataaataataaatgagattataatttattgatcaatttttttaacattacatttatattcatttggtaccacagcatggattatttaaaaactgatgattacacattggtctctttccagggaacttagaggaatggtttaaattggttgcctattatatgtaagtttgtttaaaaatatctaaattatttatgcttctttcaatttatgtaatagattttaagagtccaaagatgatgactcaaactatttactttgttttactgtgtttgcaaaatgagtgaggtaaaagactggaattatctgccaacatcgtctgtattgtgttatgctagaaacatataattagatgaacattttttacttatttttgttcttaaggttaagagacgacagccttttctgactggggaaaatgctcacatctttttagttgagactcacccttatgtagcaatacactggccgggaaatgtaaagaaagttctaggttttaagtaattaaatttatgattatctttccctaaaggactctgtgaattggctcaatagctatttcctacctcaggattcaagttccatgttgggctttggtaaggactccttcactcctacttctagactgagtcccaagcttccaacctgagcatttgtatcatctggggcttcttaggcatcaccacaaagtgatcatgagaggaacaggagacaaatgcagaccttagtcatttacttatggcctgttttccatggtggaccaagttgaaattgaacacacccatatacaaacatccatactgtattgattctcctaagccaactctactggttgaactgtgtgggaaagatacaaaatgtaactacatggactaatcttgcaattccaagctaaacaattatttagcatatagtctcagtttaagatgcaaaagcagaaactattgtggccagagattttagaattctacatctatacttgtacttcactttgcctagttgctggttcttgtctatgctcagtgtaatttggggcactttactgaaaaatctgtacttaaatcaagtcatttaattaattagataattaatttagttcatttttattttggtgagaacatttaacatgagatctaccctctctacaaatttttaaatgtacaatgaagtgttatttactataggcacaacgttgtacagcagatttctagaacttaatcatcttgcataagtgaaactttgtaccgattgaatagcaagtgcccatttccccctgccagtccctggcaactgccactctaatttctgcttctgtgatttcactatttcagatactttatataagtaaaataatgcattatttgttcttctataactggcttattccacttagcataacgtccacaaagttcatctatgttatctcatgtggcaggatttcatgattttttaataatgaataatattcaattgtatttatataccgtattttttatctatttatctctagttggacatttaggttgtttacatatcatggctattgtgaataatgctgctatgagcatgggagcgcagatatgccttcgggatccatatttctatttaataccagtaaatacccagaagtgggattgctggatcatttggtaattctattttaaattttctgaggaacctccgtattgttttttatagcagatccaccattctacagtcccactaacactgtaccagggttgcaatttcatcacatcttcaccaacacttgatatctttcctttttatcttagccattctaagaggtatgaggtgatatctcattgtggttttgatttacatttccctgattattagtgatgctgaacatctttttatatgcctcatggccattcgtatgtcttgttgggagaaacgtcgattcacagtttttgctcactttttaaatttggttgtttttctgctactgagctgtaggaaacctttatatatttgtatattcgccccttatcagatatatagttcgcaattttttttctcattctgtaggttgccttttatctgttgtttccttttctgtgtagaagctttttggtttgatatagtcccctttgtctattttttgcttttgttgcctgtgcttttgaggctacagccaagaaatcattgccaagaaccaacattatgaagctttccctgctgtgttttctgctaagagttttaaagttcaggtcttacacttaagtctttaactcatttttagtgaatttttgtgtgtggtgtatggcatgggtagaatttcatacttttgcaagtgaatgtccaatcttcccagcatcatttactgagaggactctttcccagttgagtgttcttggcacccttcgtgaaggtctgttgactacatgtatgggtttaattctgggctttccattctgttccattggttgtataggtctgtctttatgccagtatcatactactgggttactgtagttttgtaatacattttgaaatagtgaagtatgatgcctctaactttttttaaacaagattgttttggctattctgggtattttgtggttccatatgattttaggattttttctatttctgtaaataatgccatttgaattttgatagaaatttcactgaatctgtagattgctttaggtagtataggtattttaacaatatcaactcttagtcaattttctgttgctatcacagaataccatagactgtgactgggcgtggtggctcacgcctgtaatcccagcactttgggaggccaatgcaggcagatcacttgaggtcaggagatcgagaccagcctggccaacatggtgaaacctcggatctactaaaaatacaaaaattagccaggtggagtagtgggcacctgtaatcccagctactcaggaggctggggcaggataattgcttgagcctgggaggcgaaggttacagtgagctgagatcgtgccactgcactacaacctgggcaacagaatgagactccatctcaaaaaaaaaaaaacaaaaaaaacccagactgtgtaatttataaagtttatttacctcatagttctagaggttaggaagtctgagagcatggtaccagcatctgctaatagccttctggctgtgtcataatatggtggaggacatcttatggcaagagggaagagtgtgtcagctcagatcactcttcctcttctcatagagcctccagtaccatcatgggggccctagcttgatgaccttatttaattctaattacctttcaaagaccccatctccaaatcccattaacatatggatttggggattaagtttccaacacacacacgacatttaggggacaccatcgaaccatagcattctgcccctggcccccaaattttattttcttttcacatgcaaaatgtattaattccattccagtagccccagagtcgtaacttgtttcaggatcaactcagaagtccaaagtccagagtctcatctgaatcagatatagatgagactcaaaatgtgcaatttccttgccagctgcaagcccgtgagatcaaaacaagctatgtatttgcaaaatgcaatgctaagcacaggatagtcattcctattaaagatggagaaaataagcaagaaaaaataagtagctggtcttagcacgtcaaaaccccaacagggaaacaacattaaaccttaaagcttagaatgatctttcactccatgtgccatctctggaatgtactggcgtgggagggggggttggaatcttcaaagccttgggcagttccatccctgtggctttgctgtgctcagcccatgcagcagtttatacaggttggagtcttatgcctgcagttctcccaaggggactgaatacttgtagatctacaattctgaattcttgtgggtagtccttcccctgcagctccactaggcattgccctagtggggactctccgtgacagctctagcactgactgaggtgtggctcctcacaagagggcattagctatggggatctgcccgcagaccctgacctaaacgacggatgaataaaacgtacactgacacacagatattctgttttgccagtcctgctgactgtccgaccacctgcacaccaagagaggtttgtcattgcggccggccctgagcagctcgcactccaggcatttatttagtacagaattaacaacagaagctttgagtaaacacacttgtggataattaacatggttaagagagtagttctactaatgattaaagctcaggtaccgcggtttaaagtaaataccattagggggcaatagccttggtcaaccttcccccatgagggccatctggctcaaaggttagttattggaggtagggtaaacagacttaaatgaggaagactctgttgtccctagtatttaccttatgacctaattctctaatgtaagaaccggctgccttcagcctgttcaattattacaagctatgtaagctttcggccttccaaacggtttgtgactattccctataactttccctaatatgtccctttaatatttctgccaccatcctgagtgaatcccaacaactgaccttacatttctgctcagcattgcccttgtagcggctctctgctgtggctctaccctgtgacaactctctgcctgggcctccaggctgttcatgccatcctttgaaatctgggtgaaggatgttcccacagctcttacattctgcacatctccagaattagcacttcatggatgctgccaaagtttatgtctcataccgtttagagtggtaggtcaagttgcacctggagcatcttgtgccacagctgttatgatgaggagtgctgcaccagaatgcaaggaacagagacccaaggcagccctggccagtggcccatccctcaaaaccattctaccctcccagagctctgagcctgtaatgggaggggaagactcgaagatctccaagagtttttctcctgatgtcccgatagtctctggctttgttttatccatactaatctccttatcaattgatcacttagtcacacccttggtttcctgtgctgaaaatgctctttcattctctaccacatgtccaaaatcatttcactctgctttcattttaattacaaattctctcttcaaatcatctctttcctcttttgttttactataagctgttaaaagtagccttgaaacatcctgaatgctttgctgctttcgtatatgttccacaagctattccagttcatcactcttaaattctgccttccataaagcattcaaccatgaacatagttcagccaagatttttgctactttataacaagaatggccttttctccagtttctttagttccatatgatacctcattagagtggcttttactgtccgtatttttatcaatattttggtcaaggccacttaagcaatctctaaaatgttttagaatttctctggtcttctcctttttctgagccctcaccagagtcactgttaatgcaccatttatggcaatgcaggtatttttttttcctagtctgttcctccagattatttttatttatttatttatttatttatttatttatttatttatttatttgagatggagtctcactctgtcgcccaggctggagtgcagtggcgcaatctcggctcactgcaagctccacctcccgggttcacgccattctcctgcctcagcctcctgagtagctgggactacaggcgcctgccaccacgcccagctaatttttttgtatttttagtagagacggggtttcaccgtggtctcgatctcctgacctcatgatccacctgcctcggcctcccaaagtgctgggattacgggtgtgagccaccgcgcccggcctcctccagattcttacagcctctacccatcacccaattccaaagctgtttccatattttcagatctctgttatagcaatggcctcacttcttgttgccaattttctaccttaagtgcattttccattgctatggcagaataccatagactgggtaatttataaagaaaagaagtttatttagttcatggttctggagtctgagaagtccaagagcatggcatcgacatctggcaaggtcctttttgcttcatcataacatggcaaaaagcatcatgtgacaagagggcaaatgtgtgttacctctcttcctctttttttttttttgttaactagtttctaaattgttatttatttttatttgtaacaagccatttacttaagtttatgtaaagggatagtttatgcttaaaggatagcagaggttgttgctgttctatttagcgtatagcaaacatggccagattttacttttgaacttcctggaagctcttcattggaccttgagctaacacaatatatcttttgtcaccaaaagagtattattcttatgtcataatgagaacaataatttacatgctttgcataataaatgcctaaaagacattttattttatgactgcattatttttcttgctataatggggatattgtaaatcatatatttgtataatattgatggtacttatttattttttatatgttactgtatgatgtacattacaaaatcaaagcaatttgtcttgatctcttaatcttaagagtaacactttaactcacttaatctttctaatgcatattacaagtgatgtatacttttttttgaagttacatacttgccaatttaatttcaaagctacaaaccaagctcaagtctcaagtgcagcaaatgcctctgaaatgaggtttctatggattcataaacataaaacaatcagtgcaaaagaataattgaaatgatttgtctcctacttttttttttcttgtcccaagcatttttttttaattatactttaagttctagggtacatgtgcacaatgtgcaggtttgttacatatgtatacatgtgccatgttggtgtgctgcacccattaactcgtcatttacattaggtatatctcctaatgctatccctccccgctcccccgaccccacgacaggccccggtgtgtgatgttccccttcctgtgtccaagtgttctcattgttcatttcctacctatgagtgagaacatgcagtgtttgttttttttgtccctgcgatagtttgctgagaatgatggtttccaacttcatccatgtccctacaaaggacatgaactcatcttttttatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtgtatacccagtaatgggatggctgggtcaaatggtatttctagttctagatccttgaggaatcaccacactgtcttccacaatggttgaactggtttacagtcctatcaacagtgtcaaagtgttcctatttctccacatcctctccagcacctgttgtttcctgactttttaatgatcaccattctaactggtgcaagatggtatctcattgtggttttgattacccctcttcctcttttaataaagcctccagtacaatcagggaggctccactttaatgaccttctctagtcctaattacgtcccaaaggcgccacctccaaatactatcaacatacaaaattggggattaaatttccaacacatgaaattttggggacacattcaaaccatagcaggtaatatggacattttaacaatattcactccttcaatccattaacatgacatgtctttccatttatttgtgtttcctttaatttcttcatctgtgttttgtattttttggtgtataagttttttatttcttagtattttaagtattttaaatgtttatttaaaacttaagtttatttctaagtattttattcaccttgatgctattgtaaatgggattgttttcttaatttccttttcagaaaatatatggttggtatattaatatacaacaaatccttgtatgttgattttgtttttgtttttgtgggtttttttttttttttttgagacggagtctcactctatctcccaggctggagtgcagtggcgtgatctcagctcactgcaacctctgcctcttgggttcaagtgattcgcctgcctcagcctcctgaatagctgggactacaggcatgtgccaacacgcccggcttattttttgtatttttagtagagacggggtttcaccatgttggtcaggctggtgtcggtctcctgacctcatgatccgcctgccccggcttcccaaagtgctgggattaaggtgtgagccaccatactcggccttgattttgtatttttaaactttactaatttttaaattagttctgtttattctggagtatttagggttttctacacggaagatcatgttacctgcaaagagattttatatctttctttcctatttgaatgccttttatttattttccttgcctaattgcttttgctaggattccagtactatgttgaatagaagttgtgagagtgggcattcttgccttgctcctaatcttagaagaaaagccttcagttttttattattgaatgtgatgttagttttgtttattatgttgaggtaatttatccttattcctagtttgttgagtgtttttatcatgatatggggtattacattttgtcaaatgctttttttattacatctgttgagacgatcatgtgatttttatcctttattctgtcaatgcagtgctatgctctgaatgtttgtgtgcctccccctatttctatgttgaaacttaatcaccaatatgatagtatcagaagatagggcctttgggaagcaattaggtcatgagggcagagctcttaggaatggggttagtgcccttacaaaagaggacccaaagagctcccttgccccttccattatgcaaagacacagatagaagacaccatctatgatccagagagcagaccttcactagacaaaaaatctgcctgggccttgatcttgaatttctcaccctctagaactgtgagaaataaatttctgttgtttataagccaaccagcttatgttcttttgttataacagcttgcacagacttaggtaggtggtgtgtatcacatttattgatttgcatatgttgaaccatccttacatcccagggataaatctcacttggtaatggtacgtgattcttttaatgtgctattgaattctgcttgataatattttgttcaggatttttgcatctatattcttcaggaatattggcctgtaattttctttcctttaggtatctttggttttggttatcaggttaatgctggcctcataaaattagttggttaatgttccttcctcttcaatttttcagaagactttgagaattattggtttgaattcttcttcaaatgtttggtagaattcatcagtgaagacatctggtcctgggcttcttgtcattgtcagaatatttttgattactgattcattctcattatcattatatatatatgttatgattttctatttttcatgatccagttttggtaatttgtatgtttctaaaaaaattatccttctagtttatccagtttgtgtaaaattgggtaaggtaatctcttatgtcccttctgattttgtggcaggggttgtcatgtctcctctttaatttctaattttatttatttcagtcttctctcttttttcttagttattctagctaaaggcttgtgaattttatctttccataaaaactctaaatttcatttttttattgttttttgatactcaattttatttgttctctaacctttatttccttctttcttctaacatttgtctcagtttattcttttctagttcctcgaggtgtaaatttaggttgttttcgagaaacctttcatcatttttaatataggaatttattgctgcagactttacttctagtactgcttttgctggaccccatatagtttggcatattgtatttttgttttcatttgtctcaagatttttattttatttttttctgtagacctcctctgtggacatcaagatatttttaaatttcccttttgattcttctttgatccatttgttattcaaaagtgtgttatttagcttccacacatttataaattttccagtttttcttttgctattgattgctagtttcattccattatggttagaaaagatatttggtataatttcaatcttcttaaatttattaaagcttgtttttgggatctaacgtgatctatattgaaatttttctctgtgtgctttagaagaatgtgtacttattactttggggtggaatattctgtatatgactgttaggtccatttgttctatactgttgttcaagtctactcttatgatattgattttttcgtttggatattctatccattattgaaaattgagtattgaatcgcctactattattgtattgctgtctatttttcctttcagttatgtgaatatttgatttttatatttaggagctctgatgttgggtgcatatatatttatagttatatatttctgttgcattggcactattatcattatataatgtcctttttgtctcttgtgacagtttatgacttactattttgtctgatataagtatagctactgttcctctcttgattaccatttgcacagaatatctttttccaatctttcactttcaacctatttgtgtacttaaacctaaaatgagtctattgtggacaatgtatagttggatcttatttttttacccattcagccactcaatgccttattattggggagtttaattcacttacatttaaagcaatttttcttagggaatcatttattattgccattttgtcaatcaatttctgtctgtcttttagttcttttctcccttttttcttctcttgcagttttcctttgtgtttcatagatttttgtattgatccgctttgattcctttctgtctctctctgtctctcttatttttgtttatcttctatagttattttcttgtggttatcataagacatatttaaaatgtcttataggagtctattttaagcagatgaaatgtatatcacgtacaaaaactgcatttttacctctgcttcacacattgttattaatctcacagtttgcgtttttctttttctttttttttttttttttttgagacagagtctcactctgtcacccaggctggagtgcagtggcacgatctcggctcactgcaacctccgcctcccaggatcaagcgattctcctgcctcagcctcctgagtagctggaactacagatgcacgccaccacgtctggctaatttttgtatttttagtggagacagggtttcaccatattggccagcctggtctcgaactcctgaccttgtgatccgcctgccttggcctctcaaagtgctgggattacaggcatgagccaccgcgcccagctccatgaatgtattttatagttacttttaatacttttgtcttttaagttatataatatggttaaaagtgatttacccaccagcattacagtattataatattctgaatttgcctatatatttaccttgaccatcgaattttatgcttctgtatgctttcgttttgctgtttagcaaccttttatttcaatttctgcattttttgtaaggcatgtctagtgttaatgaactcctgaagcttttgtttgtttaggagcatctttatctttcctcacttttgaagaatagttttgctgttatggttgacaaaggggtttttgttgttgttgttttctggagatggagtcttgctctgtcgcccaggctggagtgcagtggtgcgaactcggcttacggcgacctctgcctcccaagttcaagtgattctcctgcctcagcttcccaagtagctgggactacaggcacccgccaccatgactggctaatttttgtatttttagtagagacggggttttaccatgttggccaggctggtctcaaactcctgacctcaaatgatctgcccacctcggcctcccaaagtgctgggattacaggcgtgagccaccatgcctggcctcttttagtacttttattatattattacactcctttctggtatgcaaaatttttgctgataaatcctctgatactctaattgaatttcccttatacatgccaggtcactgttcttctgctactttcaaaatgctctctttgactttaacttttgataattgattataatatatcttagtgtagattttctgcgttcatcttatttggcatttattgggctttctggatctggatgtccattccctttccaagatttatgaagttttggatattatttatttgaatactctttctgtccctttctatatcttttttctttctgatgctcacataatgcatatgttggtttgctttatgttgtctcataagtctcttaagttttattcacttcttttcattctttcttctttttgctactccgacttgttaatttccaataacctgtgtttgagattactgatcctttgtcacgctcctggcttcaagcagtcttccttctttggcctcccaaagtgctaggattataggcatgagtcactgcacctgattttgctcatcctttcttctgcttgatctagtctgcaattgaacctctctagtgaatttttcagttcagttatttattgaattcttcagcttccagatttctgtttggtacttcttatattttctctgttgaaattctcactttatttatgcattcttctcttgacctccttgagcatctttatgatggttattttgatttctatgtaaggtaaatcaaatatctccataccattagggtttctggaaatttatcctgttccttgttctggaatatattttcctgtgtcttcattttccttacatggttttagtttcatagtactagaaaggcgaaaacatcccccagttagatacagtacccattttcataagacatttaggtaaaaggggttacagctaccttacataaagcttgtttaaacatcttacacctgttataattctattaacctgtatgtttttatgttctgatcccaggaagcctttttacccccagaccattttaccttttctggtgaaaagggtttgaaagggggttgggtctgtaagacctatgaggatagcagatttgataaggcttcttaaatagtcctatgattctgtgggaggggcacccatgtaaaaagggcccccttaacccccaaatttaccatgatccagataatagacatattaggtgggaggatatcacagttatcataaatctagtccaacatggcttgcgtatgaaatatattaacggtttcatctggggtacttcacttggtattttatagagagagttgggcagtccccttcttagggcaaatagaccttttaatggcattatctggcccactaggctgatcgctttctcaggaataaccccctgtgcattagtgattgttcagtaatgagctgttggtcctgtattaatccaaacaagcttttaaaatctgtagcatttaaaattaagaattttgttcttaaagtggttatttttacaatccactatagtgaagtttctttaaagaagccgaattataccaatctacaaaatggaacaatttctttatattacaccctttggttttaaatagttaattggttttgcccttccctcatatcgactattttcttggtaaccatagggctcagagttttgttgccctggcttgttctttttaaaatttacttagttttatccgtataagttcctttattataaagcaacttttaaatagatctttaagcaaaaaaacttacttttttgagaattgacatccttttgtttataaaactttaacaaaagcatattttatgcttctcctattttaactttttagtaacctaaatttctaatgggggaaaaaaatccaagggtttaaacaggactttaagatttttaaattactggagagttttcagattaaatttaccaaattaatttttaccaaaaaattaccaaggttatgtaaattagaaggcatctgagctagcttttaccaatctaataagcacttacattttttaagttacttgattagagctctcacatgtagttttgaagtgaaacatcacttccacatgacacatataaagatcgagatataacaggcatgcagaataaaagccatgttcaaaagatacttaatttgcctgttttcgaaaacaatttttctcccttacttagataattagtaaaagttacaggagccaacaaaaggtagaggaaaggaaagagccatcattcaaggcctttccgttttttttgaccgagtcttgctctgtcgcccaggctgcagtgcagtggtgagatctcggctcactgcaatcttcacctcctgggttcaagagattctccaagcctcagcctcctgagtaggtgggatcacaggcacccaccactacagccggctaatttttgtatttttagtagatacaggatttcaccatgttggctagcctggtctcaaactcctgacctcaggtgatccaccagccttggcctcccagtgtgctgggattacaggtgtgagccaaggtgcccagcctggccttttcaaaagagaaagagtggcacttttaagatatcaatctgaagaatgttaaagaaacagattatagaatttaaaagtttaaaaacttcttgcattaaaaataagtcagtatttgtaataaaattttgttttaaccaattatttagttttgtattagtgcatttccttttaatattaaagacccatctctagaaatattattatgatttcattttaattatagccaactgaattatacaacccctttaaaaattcattttgctgaccttactacgacttatgtagttcattcacaacatgtttagactgttttgtcttaaacatccctttttcttgtacaaccccgtcatttttattttagggcaaaaatttaccacacaagattctttcctatataaaattacttttttttaccttttttttttttttaccaaaaatacctctttatatctttaactttctttacatctcttattttctgattcctttaccttgttttttacataacccttaaataagccttgaattagacaaagatattttacctttaataagaatatttttttaaaaaaggttttcctgtaattcttaaattagaattgcccatttaatactaattaataaccttagatcctaaattatgacaagtttgtttaaaagcatttatcctgttacgtttacctgattaatttagtagtttacctagattatttacaaaaactgtgatagccaatatttaaagttatttttctattaaccattcttatagctgtgagtttcaggtatctacttaagtaataaaacttatggttagttttaagggtatttataccaatagctgagtatttagctgttttcatttaagccaaccatatttcataagcatatacaagcaaagatcattctgtcttaggctgggttttatagtttataacccttatggcaaatcttatagtattctgcaggaataaacatgaagctacttgattaatagatgcaaacataatgttaacaattctaaagacattgctgatattattttaccaataattttaacgccaccttatttagtaaagatttcacttaagtcacatgagcttgaaaaagcatttgactagtcttcctttttttctaagtatctgatttgagcactttttaaagccaattaattagagctctttacatatttttagtattgaagatgttgtgtacatacacataaatatatagacgtattaagcatgccaatagaagcacattgcatagacttataaagaccttcttttttttttcatgttttaaaaatcttaccccaggcagttgtcagctaaatagccttacatttgtgtattaaaagcaactcaggtgaaaatcagatagcaaagtttacatcataaggtaagaagagaaagtctggtgtgctagagggaaattaaaaaggattcaattgccaattgaacataaaattatagaagtctattataaaggcctttaaatatacacacacacgcaaagttcccgtagctattacttcagtactttagccatgagacaaatacaactttgccagtttgcaaaacaacaacaacaacaataacaacaacaacaacaacaaaaaaccactgttagatggcagtggtttttatctcagttgaaaagtaacagcagatttaaagcaggcagaaaataaaatagaacccaaaagctctatagtttgcaggtcaaccttaggactctttttccttaatgtaaatgtgcacaaagaccatattacttccattttatataactctggcaagtacaggtgtgataaaacctatggagcgcccagaagggggtcattctccttgttttatctttattccggcttttttttttttcttaaaggaggaactgagctgtgccctaggttcttgtgtggtggatccacgtgtgctgtttgtgggatccatgtgtgctgtttgcgggcaggactctacagtttgtcaccactgagtgtttctgccctcttacgtgtctcagtttctctctccagaggtctatgacctctgaaagggctcaaaacgctgggtaatgagcaattctatgcgtttcctggacgagccattttttaaaattgatttttgttggggatttccctgcagggccgctgcacatctcggggagtcaaccccccagacactcccatgaggctcccggtcacccaagggcacctttcagctgggaggagcaaatgccctttctcttcagagatgaaaaactcagtctctcatttatctaggaaaacaacagctcagttcctcacacaaatgcacacagacaaaccggaataggataaattttagtagaaaaagcaatagagaattccctttagaatgcatctctgaactagaattaggatccttaaacaacaacttcctaggagaaaaccaactcagaataaatcaaggaccatcaaccaaagggaggtccaggactcagaggactcaccagttccactggaggagaagctccaacgcggtggggcttcaatggacccctgctgatacgttagctccggtttcgggcaactccttcggggtcctgagtcttctctgaggccccatatgttttgggagccagattattgttgacgaaaagagtcaaactctgtaaaatattttaagagatttattctgagccaaatatgagtgaccatggcccgtgacacaaccctcaggagctcctgagaacatgtgccccaggtctttggggtacagcttggttttacatattttaggaaggcacgagacatcagtcaaatacatttaagaaatacattggtttggttcagaaaagcgggacaactcgaagcgggggcttccaggctataggtaaatttaaacattttctggttgacaattggttgagtttgtctaaagacctgggatccatagaaaggaatgttcaggttaaagataaagtattgtggagaccaagttttattgtgcagaggaatctctcagatagcagacttcagagacagcatgttgtaaattgtttcctattgcacttaaaaggttgccttgctcttagttgattatctcctggatcgagaaagaaaggaaggaaaacaaagggggaaggggcttctctatagaatgtgggtttttctcacaatagactttgcaggggaatttcaaggtctggcaaggaaatatattttggggttaaatatttttttcattgtctcataatgttatgccagagtcagattgaaaagtaagtcacaatacatagggtcaaataaagctcatctgatgagaatttatggtttgtagggcatgactccctcgaccccttaggtaggaatttgggtaagaaaaaaaatcagagcgtagtcctcaaatgcatcatcagaaaaggtcaccaaattattggagtagcgcactccaaaaccctgttcttccactaaaagaaaaattaagcaaaagtggtcagaatcaactttttcagaactctagaatataatcccaaacttacaatgactaggggaatgtttaatgaaagaagctgctgaagtttgttaagagaactctgatgatttaactcctcacttcccattccccactcccaccagctcagtggtgagtatcataaaaacagcaacccacatacctggtgcagcttgctagtaccagaggagcaatataaaacactttttttttttcttgagacagagtctcccccagtcgcccaggctggagtgcaagtggtgcgatctcggctcactgcaacctctgcctcccgggttcaagtgattctcctgcctcagcctcccgagtagctgggattacaggcacccaccaccatggctggctatttttttttaaaaaatatttgtagtagagataaggtttcaccaagttggccaggctgctcttgaactcctgaactcaggtgatccacccaattgtgcttgtttaaagacttaaaaataaggacaccatgctaagtgaaataagccaaaaacagcaagaagaatactgaataatttcacttatatgtagaatctaaacaagtcaaatacatagaaacagagtaaaatggtagctaccaggggttggtgggtaggagaaacagggagatgttggccaaatggtacaaagttgcagttatataggatttataagtctagagatataatgtacagtatggcaactatagttaataatactgtattgtagactgaaaatttgctaaataaatgtctatcagctaatgaatggataacaaaatgtgttaccatccatacaatgaaatatattctgtcataaaaaggaatggagtgctgatacgtactgcaacatgaatgaaccttgaaaacattatcgtaagtgaataaagccagtcaagaaaaatcacatattatatgactttatatatatgaaatattctcagtaggtaaatagagagaaacaaaactaatggttgccatgggctgggtgaaggtaggtatgggaaatgattgtttgggtagtgagcttccttttgggatgatgaaaaggtcctagacttaggtagtagtgatggttgtacaatattgtaaatgtactaaaggccacagaattgtgcactttaaaatggcaaatttatgttaagtgatttttactacaacaataattttataaaacaatgagaaacagaatgatgaagcaaatgtggtaaagtgttaacatttgggagtcctgtttgaatatgagaactatttgcaattttgcagattttctataaatctgaaatcacttcaaaataaaatgttacaaaaagtttcaagactaatgaatccagataacagattgttgggttattcttaagtaaaagaataggcaactcttccactgaaggtgaagggcagaagggaagtatgtgtgtggatttaattaagtttgtaactggatcaccagggttatagatcatccctgggataggggtggggtcattgttctttctgtgtaatagaaggttagtgcttttgctgaaagagaatgtcttagcattgtaccctcagaagttaatactgagacagggtttgcgtgaacatagtttatttgggtgttacttccaaaaatcaccattagatttatttaggaagttagacaggtaggagaagtaagccaataaaatgtgtactatgtagcaggtttccgctttggccaactgtggctcagtcttgctgggaaatgctgggaaacagagcagaacatacatcagaattactccattttagaagcaagggaactggaatatttcttctccatcttccacctgtcattggctgagagctcctcccagggacattagctttccacgacttccagtcctccccaggccagctgagataaaagattttagttgagaggtatgggtgtttacagtagggtgaagtcagcatgtactggagcagcagggactgaggaaatatttgaaagcattgacagcaccttcaataatgagatagaaaatgaggaaaaacatggtttgaagagagtgatgaggttaaaaaatatatactagttaggagtgggcaaagggatcctctagggaacatgtatattggttgccatgattgccatgcaggcttttgaacctgatgaaagttggtgtccatggatttatcatggcaccaatcctcccatggtcacagagtgggtggagtatagaagctgtggaagcagtcaggaatttgaccttttgtgtttttcttagcaattgtataaacctattagcacatctcactgagacttcggactacgaaaacatttgctcgtatattttcatatgaagtagaatactcttaagctggttctctttcttatacatacttaggatgtgaacctcaatatataagtttatatttatataatcctgttgttttcaggatttccaggctttagatatcggtacattttataaggtcatgaaactaaatcttcgtcagcactggatgaatgtgccaactcagtgcatagtagtgggtactatataaaagtagagtggcctctgccctccaaagctcaaaaacttgcagggggtgagaaacctgtaaatagataagcaggatacagtggattcagtgctgtgatagagatgcataatagatgctcagttaacatttgttgaataactgaatgaaatgtgatccaagatacaatttttcttgttggaatatgcttatctttaagggtgtcatctaagttgacaaaatgttgcaaatggcatgttcttagataaagttagtgactacagacttcaactgttatcaagaaaagatgtaaatatttaccatcacatggtgagaaggttttcttaactcttgcataagcagactagggaaaacagaagaaaacactgtgacccataattttccaaatttgttttcatgggaggggagaatgagacacatgagtcattttcacttctgttagctgatttttctcatgattattaagccacagaggccacattgcttcttctatggtgatcaagtttaacagagaagcatcatgagtcctgaaagaatctcactccatgacgatgaagtgtgtatattctgggaataataatgaactcatctcaccttgacactcataaaagtgaaagcctttagtagctagattttaaatattttacaattgttttattagccatgcaacaatttcttaaaatttattttcatctaacactagagacaaataaagaaaagtcctggccaggcatggtggctcacgcctgtaatcccagcactttggaaggccaaggcgagcagatcaccgaccagccttgccaacatggtgaggccctgtctctactaaaaatacaaaaaaaaaaaaaaaaaagagctaggtgtggtggtgcacaactgtagtcccagctactcgggaggctaaggcaggagaatcgcttgaacccaggaggcagtttgcagtgagcagagattgcaccaccgcactccaacctgggcaacatagcaagactccacctcaaaaaagagaaaaatccttctctatctcaaagaactcacaatcttttgtttactaacatcactttactcttaataagaatttgactttactttgaaaaaattatttatttactcaaccaatattatttagcactgattatattcataagaatgtgctagaaatcaagcacagtagatgaaaaaaggaaggtccctaccatcgaaaagctcagattcttgcagagggagagagacctgtaagcatgcaagaacaatgatttcaatattgttataggccaggaaaagaagagaaaatatctgcctagagaaattagtggagactttaggaggagaagccatcctactcagtactagggatggaaaaaaaacattttgtagacatcaaggagaaagaaggtggcttgggggtaggaaagggaagagggaagtggaagtatgaaaggcgttccaggtaaaggaaacaggagatatacactcagcaattgtgacagagcatagaatgttctggaaatgaatggtcagggggttaaatattggtttgtgtggggaggaggaaatgaggaataatgcaagggaggtaggatagggagaaatggtgaagagtcatatgagatgtattctgtactctactttgtggggtagaagggactgaatgttagggaaatactgttgtgtccaccttaaagatacaggatgaacaaccacccaaatttgatttcggtatggggaccaatgatcacacacacacacacacacacacacacacacacacacacacacacacgaagagggtatgaagatttcttactcacataataaggctttctaggaagagtagggtgactcacaagcagtaaaaatggcttgaagttttatggtggttagtgagtaaggccagggtggttcccatgcacaggaaggggttggtggcggtttgaattttccactggcaccaaaggagagaacacctagactttattgttagcttgatcacttgtaggatagaagaagaaaacggagtgtggctttacagctatcagaaatcaaacatttaaaaaatggagtcagtctctttatttcactagtgcaatcacatttttgaaaattcaaatcaaaaccaaaaagaacccagtaatagtgagaaaataacctggaaaaggatgagaatggaccagagaaaccagcaggaggtcgtggcaaatacctgggcaaacgaaaatgaggtcctgaactatcacactgacaatgaggatggtttggggaatatttctaagaaagaattgagagttggtgcccataatgagtgagagaggctattagatgactttgagatctgattgggcaactggagaaaaaatgacaactaatgataggatatatgggaggaaagacaggtggtgagggggagacaagttattatttcagttttcaacatgtgattgaaacggcttagagccaccttgtcttttgagaaatgaaccgcagtagttccaggctctgtcttttcccagatcaacttatgtgatcacataacctggtcacacatcataatgcttacaaataaagcccctctgtgaatctcaattgagcatgatttaattttcattttctatggaaattttattgtttctttccctattacaaaagcaattcatgttttatataaacaattatgaaatatagacaagtagaaagaggaaaatacaaatgaccttccatgaagaagtgataactaataccattttggtgtattatcttttagagagtaccattggagcccaaatatgagaacaaaataacctagaaaactgagaaaaagcttcaaagatgaaaaaaatgttttatttgggtctttaaggatcttgagtacatttactggctataaaggggagaaggtgaggtgaaaatggaggttcaggagaagaaggaagggtaaacattttaaagctgagattgtgcagtacattctgtattataacataatgattttaacttaatatattatttaacttaatatttaatttaatctattatgaacacaaattgtaagtgaaatttttgcagtgaaatacatacagtgattttgacattttgttttgtaaccaaagagtgtgtgagacaggtctccatcaatttagaagtttattttgccaaagataaggaaatgtccagaagaaaaaacatgaaattacacaaacagtctgtggtctgtgcctttctccaaagatgattttgagggcttcaatatttaaacgggaaaagtgggcgggaggggaaagaaggaggttatagtcacattactgaatccacatgttgcaagagaaaaggagcaggtaggggaaaggttaattatgtattcatctcactttacataagataaggtgaacatagtgtagccgctgtggggatattaaatctttaatatctagctatctgcttctgaacaaaaggaaagacagtttcttgcatgactcagccttcagcttaatttttttccttttggatagtgaattgggttctgagtttttatttttttctttcacagtttgtattatgaataaagcatactagatagactatctttctgactctggaattaaagtaaggaggtttttagatgtgataataaccactctccactttctctctcattctggcaaaatgtctgagggaagatctcactctgcaagtttagctttcatgaaatgttttcaaatggagtgatggctcctcctaactgaagacagatcttcagtcttgtgtttgcttgccactgaattgtgagagtactttttctctgtaatagagtaaatgcttgaccatttctttttttaaattttcttttcttttcttttttttttattatactttaagttctagggtacatgtgcacaatgtgcaggtttgttacatatgtatacatgtgccatgttggtgtgctgcacccattaactcatcatttacattaggtatatctcctaatgctatccctcctccccctaccccacgacaggccccggtgtgttatattccccttcctgtgtccatgtgttctcattgttcaactcccacctatgagtgagaacatgcggtgtttggttttttgttcttgcgagtttgctgagaatgatgccatttcttactgcctaaagaattaaacttcctttgcacctatctataagtaaaattctttcaacttgacttaatttgtcacttttggaaattacataatgaagtgtttttcagaccactggattatgtatcatggaagtgttttcatgcactaaatccatatggtggtttcaattgccaatagaggaaatactctggattccccacgaagtactgggagcctggggttctagtggttccacaattaggtagtgtgcaacagttatctattgccccaataatgctgcgtaataaactggcaagccttagtaaatcaaaaaacaaccagaattctactttcagtataacagtgtgagatgctctgcaaactcaaccacttaaaatctctagaaatgatcctaaaggcgtatagcaagggaataaatgtttaagaaaatctattaaaattggtgggaatagcaaaagtctatggtatttgaactaagacccagcctattcttctccccttcaaacttagtgaaatggaaactccacttaggactggtacagcaaagaacacagggttccttctccctccagtttccattccaagggctacctttaagagaagttcaggacttcagcattttttaacctgcccgcagctacctgttgctaaggctaagttctggacaaggtgaccaagaagtgggggcttgcttcttcatcctagcctccagtatataggatggaatctctaccttaggtgtggcaacattgagtatactgggacctgatcatctttgcatagattctaatccatgtgtgatccacatggagagaggcaagctgagaagaactaatgttactacctatgttcagaagtgttcagctcctatgacagggatgtcactcagagaataatgtgccattatctccattcccagcttgagagccaaggtatagagattattccccggaggagaagcaggccataaaagatagaaccgtgaatctcttccaaaggaactgactttatttgcaagaggaagtggagaaattcaagcctaatggcattctcaaaaacagtggaagttgttttaaaagacagttgagagtagattgctaaattaatcagagatatagacaaaactgtaagccgactgctttgctggagaggagcttggaaaaggacaggtgtgatgagccctactggggacagaacaaattttatttttgttttatttttgagacaaggtcatctaggctagagtgcagtggcgcgatcacagcttaatgcagcctcaacctcctgggcccaaacaatcctccctcctcagcctcctgagcagctgggactacaggtgcatgccaccatgcctagctaatttttgtatttttttgtggagatggggtttctccatgtttcccaggctgctctcaaactcctgagctcaaacgatccaactgcctcagcctccaaaagtgctgggattataggcatgagccaccgcgcccggcctgagagcaaattttaaacattgacctaggtaactaacctgtcaagagagcccagactagattggatcagtctatggagcaatttatgccctatgttagaagcaacagaacaatcagccagtaattagtggaatttaatggctggatgtgatcagggaaagagaaaaagagagctctgcccaaaccaatgtcatcccagggtaactatggtcattcccaagtctgcacctcatgaggagcagcatcaaaggttttatactgcaagagagggagagtgggttgaactacacttcactaaaataatctaaccagtcactaaacaaacaggcagaaaacagtaagtacttagaggggaccaatacccagagttgccacaacatattatctaaaatttctgatttccaacacaaaattgtaagacattcaaagaaacaggaaagtataatccatataccagaaaaaagcaggcaacagaagctgcccatgagagcaacaagacatgtgatgtaacagacaaggactttaaagttgtaattataaatatcttcaaaggactaatggaaactgtgattaaagaagtaaaggaagatatgaaaatgccacatcaaatagagtttactaataaagagatagaaatcataaaaaggaaccaaattgaaattctggatttgagagttataataactgaaatgtaaagttcaatagagggctgactagtatatttgaatggcagaagaaagaacccatgaacttcatgatttgtcaactgagattgcccaatttgaggagcagaaagaaaaaaagaatttaaaaaaattaaagaaagttcttcaggctgaaaacaaatgatcccagatagtaattcacatctatgcaaataatgactaaataagtaagataaacagagcactggtaaaggtaattatgtaattatgaaagagagtgtacatgtattttttcctatcttctcttaactgatttaaaaagcaattgtataaagcaatatgtaaataatgtatgtcatacatgtagtatatagaaatgtaatctatttttccaataataccacaaaaggggatgggtgggagaaaagccatattgggttaaggaagtgactccagatgatagctgaaatccacagaaacaaatgaagagagccataaatgagaaataagaaggttcatataacaaaagctataagtatatgtttgctctttttctctcagcttctttccaatacataaaatatataaaataataattatgtcaatgtattgctgggtttgtagaatttatagatttaatatataataataagaccataaaaatggggaaataaatagaactatatagaaataatgtctctgtatctcaatggaattcagtttctgataagttaacatatgataagccctaaagaaatgactaaggaaataactcaagaaaatatagtgaaaaaataaagaaaattctacagtagaaaatattcatttaatgcaaaaggaagcagtaaagcagtaatataggaacaaaaaggacatgtaagctataaaaaacaaaaagtaaaatggcagaggtaaatctaactatattagtaatagcatcaaatgcaaatggattaaacagtccaaataaaaggcagtttgtcaggctgaattaaaaaacaagatccaacgtgtgttgtctatagaaaacatactttagattcaaagacaaaaattgattgtaagtaaaacaatggcaaaacataatcgtgcaaataaccacaagaaagctggagtggctatattaatgtcatagaaaacatatattaaaataaaaaatgctactagagataaagagggacattttcaaatgataaaagggtcaacccactgggaagatataacgataatgatcatctatacaacagagcaccaaaacatatgaagcaataaatagacaatttaacaataatagagactgaataccacacttccagtaatggagagaagtaggtagaacataaacaataaagaggatatttgaacaccacaaaccaactagacctattaggcttgcatacaacactctacccaacaaagtaggatgtttatttttctcaagtgcacacacaacattctgaatagaccatgtgctaggccataaaataaacctcattaaatttaaaaggatagaaaaaatgtccactgttttttctttccacaatggagtgaaactacaaacaaataacagaaagaaatgtaggaaacccacaaatctgtggaaagtaaacgacacactcctaaaaaacaatgggtggaagaagaaatcaaaatgaaaattagaaaataattagggatgaatgaaaatataaacatcacatacctaaacttatgagatgcagctaaagcagtggttagagggaaatgtatagatgtaaacacagatgtatatttaaaaggaaagaggatctcaaatcaataaattaaccttccacctaagagactgaaaaaagaagggcaaactaaactcaaagctagcagaagaaaggaaataatacagaccggagcagaaattaataaaatagtgaattcaaaaaaatagagaaaattaaaggaactaaaagcttgttcttggaaaagatgacaaatttgacaaacttttagctagataataaaaaagagagaattcatattgctggaatcagtaatgaaaagggaatattactactgccattgcagaaataaaaattatcataaggaaaggccatgaacaattttattccaataaattagataacttagataaaatggacaaattactagaaaggcataaactactgaaactgactcaagaagaaatagataatctgaatagacttcttctaagaaataaatagattgaattagtaatcaaaaaactacctaccaagaaaagcccaggcccaaatggcttcattggtgaatgctaccaaatatttagagaacaattaatactaattcttcacaaactcttacaaaataatggaaaaggagggctaacttcctaaatcatcctatgatgccagcattgcccagataccaaagccagataaagacatcacaagaaaggaaaactacagaccatatatcttaagaatatgggtacaaaaaccttcaagaaaataataggaacttgaatccagcaacatataaaaagaattgtacaccatgaccaagtgggatttatcctagcaaggccaagttggtttaacaccccaaaattaattaatgtaatacactacatcaatagaaaaaacatataatagtctcaattgatttagaaaaataatttgacaaaatccaaaaccatttcaagataaaaaatattcaacaagctagaaatagaaaggaacttcctcaacttgataaagggtatctatgaaaaacctacagccaacatcatacttaatagtgaaagactgaatgtttttcccctaagatgaggaacaaaacaggatgtctgctctaaccacttctactcaatattgtactatgggttctacccagggtagttaagcaaagatacaagtaaaagccatctagtttagaaaggaagaagtaaaattaactctattcatgaataacattatcttatatatagaatatcctaaagaatccactaaaagtctattagaactagtaaatgagttcagcaaggtttatgggatacaagatcaatatataaaaatcaattgtctgagttacgagcataaatgtaaacaaagaaaaaatgttaaaaacaaaaatatcaattgtctttctatacacttccaatgaacaacctgaaaaggaaattaagaaaaataattataatgcaacctaaaataataaaatatttaggaataaatatcacaaaagaagggcaaagactatactctgaaaactacaacatattgttgcaaaagtaaacatttaaataaatggaaaaacatatcattttcatggattagaagatttaatattgtcagattggcaatattccccaaatttacctacagatttaacataatccatccctatcagaatcccagtttatttcttttttagaaattcacaagtggaacgtaaaattcatatgaaatttcaagggactcagactaattaaaaaaatattaaaaaacaaaattgaataacttacatttccttatttaaaatgtattacaaagcaacagtaatcaagacattggaactggtataaacatagacaaatggattagtggaatcaaattgagagtccagaaataaacccatacatctatagtcaaatgatttttgaccattcaatggggaaggaagagcactatcaaacaaattgtgctggtataactgcatagccacatgcaaaagaaagaaattggacccttaccttagactatataaaaaaattaactcaaaatgaatcaaagaactaaatgaaaaagttaaaaccataaaacttttggaaaaaacataggaaaaaaatcttcatgacctctttttgggcaatcgattcttatatgtgaaaaaacacaggcatcaaatgaaaagaatagataaatcgcactttatttttatcaaaataaaaacttttgtgtttcaaaggacactattttttttttttaaagaaggaagggctttattcagccaggagcttcggcaagactcacgtctccaacaactgagctccccgagtgagaaattcctgtcccttttaagggctcatgactctaagggggtccacatgagagggtcgtgattgactgaccaagcacggggtatgtgacttggggctgcatgtaccggtaattagaacagaacagaacaggacagggattttcacagtgcttttctatgcaatgtctgtaatctttagataacataaccgattaggtcaggggtcgatctttaactaccaggcccagggtgtggcaccgggctgtctgcttgtggatttcatttctgccttttagtttttacttcttctttctttggaggcagaaattgggcataagacaatatgaggggtggtctcctcccttattcccccgctttgagaacctcattcaatagtggaagttctcacttttattctcactacccatgtcttcttgcaagacagatcaatagtgattcatatagtacacttgtgctgaagcattttggtgaactaaggtagtgatgaagctttttatcatttgaagaagtacaggtagcaaacaagggagcagtaagcaggtttctattactattataactcataagagttttaaatctttttttattattatactttaagttctagggtacatgtgcacaacatgcaggtttgttacatatgtatacatgcgccatgttggtgtgctgcacccattaactcatcatttacactctcattttttgcactcaggttcagcatacttactagctttcatttaaaacatgccaaatactttactagtctggggatttgtccatggaatgttatttatcttaccacttctctgactcattccttattcttgtgacagttctaaggttcagtgtcatttcaacattcctccataaccctatgtaaattacatccttaaaataacatttaaaataacattttaaatgtgaataagtgattatcaattgagaataattttgtcctctggctactttttgacatcacaactggaagatgctactatctagtggataggggccaaggtactgctgtccttttttaccaggaacagcctttatgccacaaaacaaagaattattcagtccaaaatgtcaatagtgctaaagtttataaactctgcttttgatcatgcacaataaatttgaaatacatatttgtttgggtgtttgttttaacatctgtctttcctactagactggatgtttcataaggatgagatagataatgcctagtttgcttaacattgaatatccagcatcaacctcagtgtctgatgccaggtagctacatgaaaggatgaaacagcaggcatgaggtaagaagaaaaggaaaggctttattaggagggtatacaaacatttctgggtatagaagatgctgtcagtgccctgtccatactccaacagctcataccatttaagtagatatttgcctgactttcaaatgtcagaacccttatttctttgtgtgagacctttcattaggtcatcagagcccactgtgctcaataatatgacagtccagaacagtgggacatcatctgcccctggaagatgtgtttactacagcgttctctaaagttttacagtgacattagctgcttgataacgaatactttgtttgcttcctttccttctctgtctcaattcctctcttccctgccagagtttcctgggaataactcctgtgataggccgagtaatggtccccaaagatacttagatcctaaccccttgcacttatgaatgttgccttatatggaaaaagagaattcacaaagatgattgtggaagatgggagattattctgtattatctgatagaacctaaggtcaatcacacaagttcataaaagagtgaggcagaggcgaatttgacacagaagaaggaaatgtgactactgaagaaaaatgctatgctgctggctgtaaataggaaggaaggggcccatgagataaggaatgcagctctaggagctgggaaagtcaaggaaacagaccctcctctagagtccccagagggagtatggcaatgttgacaccttattttcagcctagtgaaactgattttgaacttctgacctccaggtttgtaagatactaaatgcgtgtattttaaagctaccaaatttatggcaattcattagagcagccatagggatctatcacaatgtttggtccctggaagtgggttgctgctataagaaatatctaaaaatgtggaagtggctttgcaactggataatagctatagactggaataattttcaggagcattatataacaaccttagattatgttgaacagatcattaatagaaatatgaatgttcaaagtgttcctggtgagagctcagacatgaggaacacagtagagaaagtctatattgtcttagagaacacctaaattatcataaacaaactattgatagaaataaaatgtcaaaggtgttgctggtgaatgcttagaaagaaattagtaacataatatcagaaaagggagtttgtgttatatagcatcagaaatcctacctgaattgtgctctacaattatgtggaaagcaggacttgtaagcaatgaacttgaatatttagctgagcagattttcatgcaaaggattaaaggaatggcctgttttttattgctgtttatagtaaaatgccagaggaaagacataaattgagggaagaactgttaagcaaaaagaaaccagaattcaatgatatgagaaattttcagcctatccagattgcaaaagacaccaaaattaggaaattcattgccacaaaatcatcctccagagataaaatcaagggcgtggctagacatccttttgttagtgcctttaagggatcaaaagatcaaagtattcaatcacatagatggtgttttgaagagatatggggtgtgcttctcagaataagcaaggaatagagatgggattttctatgagggatcttgaagaagcctcttgtctaatggcatgaatccccatgacatacataaaaggcctgtaagtttttgacaatgttatatcagcagaaacaatgccagcttagactgaaagggacaaatagaggaagaaatgaaagaagtctacaggactctcaaaatttgacaggaggaagcaggctgataaaactactcagctgtaaacatatgctaccattcaaaataaaggaacaatgactgagggcagaacctagaggccagagggcagatttatgaccccaggtgaagtcataggatcagagtcatcaaagggaggagtctcaagccttagaatattctcaggccttgaaacctaatggttggattttgaaaatgcttggatttgagactcctttttctttccactttttcccttgtggaatggcaaagttattggctgtaaatgaaccaaagtcaaagggaaaacacagaattagtagagaagaaaattaaataatagaaaagaaacatctcttagtgctttggcttcacctaggagggacaagaaatacacatctgggcttaaactgagcacaagatgcacttctctatcaactgtttacctggcactgacaggtaaacttattgaacatcttattattattattatttttgagaccgagtcccgctctgtctcccaggctggagtgtggtggcacgatctcggctcactgcaaactccacttcccgggttcacaccattctctggcctcagcctcccaagtagctgggactacaggcgcccgccaccacgcccggctaattatttttatttttatttttatttttagtagagacggggtttaactgtggtctcgatctcctgaccttgtgatccacccacctctgcctcccacagtgctgggattacaggagtgagccactgcgcccggctgagcatcttattattaattgaaaaatgactaaaatatatttttcaaatggggtaaaatcatgacactcatacagatatgaaatgaacacatgctaaaagaaaaagatgttatgactgcttcaaaagggaaaccaaagagttgatatgggaatattcatcagtaatattaaatgattgtgtaaatggaggcaaaactggtttcataaggtgaagaacaaccgaacctctactaaagaatatgctgtacatgtatcagcagcctacaactaacaaaaggctataaaagacttcacagataatgtaaggctggaatcagataacctgcagtggtgtcctaaagacagagcaaagttttccactgaagcacacatttatttttataatgtcaaaatcaggtagagagttatagttccctcaaaatcaaggttcagtcattagcgtgactagatcagtgtcatagacatttctaggctgaggtctgataagggaccagtggacaccaatgaaatcacaaagtctagggatgtcacaaaggcagctagctccctgaccaataagggcctggagcagagggatacaataggcaggactaagcactagtgtcctcagagacctacttgagctagagaatcaagcagagctgatgagagccaaacccagcaaacatcatgtcagagaaaaagaactgtaagaactcgtctacaaataacaaccagactcaagacccttctagaaatgagctacaggtccctaggagcttcgtggaccgcgttgtgcaagatgaacgagacgtccaaagccagagttcctccacaataaataccctccttaccttgctcgattgccttgctgactacatcatggagcgggtaggcttggaggccagcaacaatggcagtatgcgcaacacttcacaagatagggagagagaagtggacaacaaccgtgagccccacagcgctgagagtgatgtgactcgctttttgtttgatgagatgcccaaatccaggaagaatgactgaagactgggtcccagagccttgaagggaacctcacaggcttagccagggcaaaaatgtgtcacagctgaggaatatctgctgttgtcatcaacaagtgctattaaaggatgtaaatccatgagtatgtttctgactcctctcagtttctgtcgctttgggttgtaggtgtctgtaagacatccaggggaagctatccccagagagctgaaggcggggaaggggtggccagtgtggtgtttgaatcagtgatttagagggggcagtttccaatggtgacagtgagggcgccggccctgtggggaggaactggctgggataaagacaccgagacttcctcattgtctctgaacaggaaggccttgtgaggccagggagttggctgggggcctctgaggcttgttgaattcccagcctgatgctggggcctgaggtggagctgcagactctgactgaggtgcaggaggctttattcaggatagcaaaggtctgaagtcagagggcggtggccacaggggtgggtggagaggggcacactggctggcatgaagttcatgggacaggggctttacatggagattgaagagtgaaggagaaaccatcatgaaaaatgcaaaaaagaaatgatggcctgctggatttcatttcttatttctttatgccctgccttattatgaaagcggatttgagacagggattattagctagtgctgtgaatatatctttttgtcctctcttcaggacactggtaaaataaatcaaaagaatatataaaatttatgatctggcctaagatgggcaattcaagaagttcttaatggttgttaattattaatgaatcagcttaattataaatgtatttcatttaaaacacgattaacaatttcatttttaaattgaatacttattcattataattaccatatattgcatagagcaccaaaggattattagtgactcaatccatgttttaagaggtatagaaataattctgtcccaagtggcggcctctaaagcacatgcaatccttttcaaaacttcctgctctgtgctaagtttaaaagaggtgtcacatcaagtgttgtagcaatctgtccccttgcctgtgagtgcccacattttaggtttccacctcttccttgggtccttgggagccacagtctgctgcctgctggcctttcacagagggttggtcagaggctgcacagccggctccaacaatgggagctgcgggcctgggtttcagatcccagttcaccacttcctggacatgtgatattagaccttcaattactccctctgagcagtcctcctcatgtgtaaaatgggggtagtaaaagtctctccatctgtgggttttcccaagattgagtccacttgtgcctgtaaactgctgttccacacagtgcatgcacagggtcccccttaataaacagttgcatctccttccttccctaacagcagacctgtaggcaggcttccccaaggtgcagtggtcctggttctcaggtgaccactggggacttaggccactggctgtgagaaccacatcctgctgagccctgtggagagacaggaggaatttgggaatatttaatttatgtaagcaaaagagactttataatcgaacacgtcaataccatccagaggtaggaaaactttacataatcacacaatcagaggtggagctatttcagaattacaagcacatagacatataggcacagagagatagagcttatagcttcagttctacaatttcaaccgtgagtcaagtgtaaatagaaacagtaaagttctctgatccaaatataaaaaaaaaaactgttctcctctaagagagtataaaattcttaattgatttgagctataaatagacaaatggacaaaagactgtcaaaccagattttctgttgtcttttacacaacagagactgtatttctatgaatcattaactcatttacacagctctccagatggttggatcctaaaactgaattcccaaccatttggtcaacaatgaaaataacttacctaatgtcaatgaacaacaacaacaacaacaaaatacagaattagtagagaaaaatattgaaataaaaattaaatgttgaaactaaaattagaaaaacacaatgaacaaagacttatttgggctttggagtcacctagatgaggcaagcaaagacattcctgggtttaaccaagcatgaagcacacatctctgtcaccaagtttgcctagctctgatagatgaatccactgggtataacattgtgacctttaaaaacaggtaaaaggtattttctaacagagtaaaatcataacactcaaacacctatgatatggaaatgcgttgaaacaatcgattaactcgtgaggaaattggcggatattataagccattcaaaagggaattcaaagaataaacataggaacattgatcatgaatgtttaagtaaatgtatacatggaggcaaaattgggagcaaggcagtgaacatgtctgtaagtgacttacagcttctagagggaatgtaaattagctcacagacaatgcaaggctaaacttaaagaacctggagtggtgtcctaaagacaggacaatactttcattgacacaattttttgctaaaatgttaaatagaaaatgagcttttccttaaaaataagttccagctactagggcaaccaggttcctctcaaaaagaagttccagttactggggtgaccaggttcctctcaaaaagaagttccagttactagggcaaccaggttcctctcaaaaagaagttccagttgctagggtgaccaggttcctctcaaaaagaagctccagttactagggtgaccaggttcctttcaaaaagaagctccggttactggggcaaccaggtccctctcaaaaggaagttccagttgctagggtgatcaggttcctctcatgggcttttctaggctgaggcctgatcagagcccagtggacaccaatgacatcaaaaagtggaggttgtcacaaaggcaactccctgaccaatgaggggctggagcatagggatacagtgggtggcaataagcactggtaccttgagaggctcaggccagcaggaaaatcaagctgtgccaattggggcaaaacccagcaattcctcatggctggaaacaaaatgttctgtaggcctaggagacaacgcctttcccattccagaagagcagagctgcagtttcctgtcagccacttggaacgctgcctgcgagaaagtcagcatgcccggcacctgagctcaaccacacctgttttcctggctggtgttctcgagtatctgacagccaacatcctggaaaaggtgggcaaggaggtcaagaacagctgcaggctgtgcatcaccccagaacacgtgaagagggcactgcaaaaggatgagcagctcagatggatcttggagttggaagatgacacccactctcaagtagaagaaatgccccaatctgaggaggaagaggaggaggaggaggagaaggaggaggagatggtggtgctggtggtgatggggggaaggaggaggaggaggagaagaaggaggaggaaggattcctgagtttcggagccatgcgggacttcatcagcaacctcctccagatgccaaaattcccatagatgaaagaccccaggttgcttccatctgcccaagctattaaactgtgtaaatgcatgacagtgctcctgactcgtctccgtttccgttgctttgggttggaggtgtctgtgagacatcaaggagaagctatccccagagagctgaagcgggggaaggggtggccagtgtggagtgtttgaatcagtgatttagagggggcagtttccaatggtgacagtgagggtgccggccctgtggggaggaactggctgggataaagacgccgagacttcctcattgtctctgaacaggaaggccttgtgaggccagggagttggctggggtcctccgaggcttgttgaattcccagcctgatgctggggcctagggtggagctgcagactctgactgaggtgcaggaggctttattcaggataacaaaggtctgaaatcagagggcggtggccacagaggtgggtggaaagagggcacacgggctggcatgaacttcatgggacaggggatttacatggagattgtgttgggattgtccttagggctatttgggagatatgcttgtctgaatcccagaagcctttcttgccacatgatttccactgaaccttatattcccaggcaactcattgtgaagatgcccaccccaccactggatgattccttatggagagctatagagcattcctagctttagcccagatggtcactttctcctctgtgcatttgagcagcaagcaggcctctctccagcatctacaggaaggaagtctccttcagctgatcaaatcatggtgacaacagcgccctctccacttgccaaagtgaaacatctttgttttcagggtatgtgttcctgctagtccagtgtcctccattcaagtgagtccctctaggatgggtaatggcagtgaactgatcattttcctcagatcttgacatgttgattaaatagctgtctggtgtttaaaagctgttgatgttgcttatggctgtggcttattgtagaactagatataatgtcctggatacactggaatgcacatctgaggacttcattcaaggcaggagaagccatagtaggtgggtggcccatggcagatgagtccctctgtgtagtcaggtggtcaccttacagtttatgcagtcgtcaacactaacggtcactctgaccttgtaaggacccgggcttctgggctctttcagactctgtttcatgcctgaggtggagtttggaggttgaccctggatgagcccctgttgcaagctctctgcagagtcaaggggcatgggagagtcagcaggaggcactgctatccctttaagaattgtgctcagctgtgctcgtgggtttcagaggaatcgtggggggccacagccagcatagcttcagactaatgcatcaccctgccagatcccccttccacacatgcaaggaattctacactcaggggaggtggggaggcagagagaatcactgttattgggaaggcatgagcccacccatatttaggccttttgtgcatttctaacaggagggagggaaaggtgaggaaggagtctctctggcctgtatcctgtggtcaggacagcactggtggccagtgtcctattgggagtgtgaaaactaacgcccaagtgggcaaggacagaggccggggtgactgtggctgccaaccaggccagggatcacaagcagtgtcagggcaggctggtgccagactcaggtcaagactgcagaaaacttcatgtgtgaagatagacaagccccagagtcaagcctgagggcaggagacttggagggtaaaggcaactttttgttggctttaccgcaaggcctggttatcaggctcgtctcccacctagagcatcttttgggaagcaaagcattttgaaggcccaggtctcctgttccctttatgtgatagatcctacatgatgtagcctatgggagatggcctgactccttagagagtacctccgttactcccaaaataggagtctagaaagagaggtacttctatcaacatctaacacatcattttcctaatcctcagattacaaagtggcagctcacatacctaatctggacagcagatgagatcattagaactacaatgctgtttttaaggaaaattattttgttgccaacattgaaaaatctagatctttcatctgaaaatctcaatttctgggtttccttagaaaatcaaaatgtctcggtatatatgtggctacagttagatagaaataattagctgctaccccattaagacgagatatttagtttcctacattcctcatgatggcagtggtggcccatctggggtggccgttgccatcatgccagctgcagcagggagccatgaccagggctgcacactttgtggagctggtgggagctggggacaagtgggagccctgtccctttcaaattggtgtggcagtagctccccggttgcagccgcagctgcccgagcggtggttgtggacccaggcctcccactccatggagcaggcaggagtcctgccctcctggacacagctgcagccatccaaatcgcggctgcagacccaggcatccctaccctcttggaaatgtctgctccccctgcttggctctccctgctgtcagtgcccactccaatctcaaagcaaagtcagggctgatcccaggtgctgtcacagccaggtcaggtgtgcacatgcttggggcagtgctgacacaccagttccctgctgccttagccccctccagactttgggctctgacaagcttaggaagggagacaatggggggccaaggacagctcagtgctggcctgcagatatcccctggcacctacagcctgggtgccatgaacggcagcaggaggcagacaggttcctaggtggaaggtccacattgaggccccgagttcaggccaggaagggcctgaaagctgggggctggactgcagtcctacagactggagcgggaatgtgttgtgctttatctgggcccacccatggccacccgtggaccagtcagcatacacttcctcccctctgaggcccttaaaagccagaggactcagccagagctgaacaaatgttgggaccaccagctgcagagaggagctagccaccccaagtcctcctctctgctgacagctgggaagatgacaggaagacctgcctacagagaggagcttcccactccaaggtctcctctctgctaggagctgaacactcatcaggacacccttgctgcagaaaggagctgccccctgtgggagactaagctattctattgctcagtaaagctccccttcatctttctcaccctccacttgttggtgtacctcattcttcctggtcacaagacaagaactcaggacccgtcaaatggtggggctaaaagagctttaacacaaacaggttgaaacatgccccttgctcgccatgttgcaggcaaagagaaagagagaagagttttggcccttcggggagcccagacctgagaactacttgagcaagggctgtcactccctctttggggctctgtggttcactggcatctccaaacttccaggtgccaccatgtttcccggtgccagctgtggaagctgcttgtcgtgcgcctggtccagtggcagcctcacagagagccggcacctattctggcatctggaactgcctgcctgccctgttgcagcagctggcatgtctgactgtgtgcagtggctgaaccccacgcttcctcacacaccccttgccgttccacaccttactcccccttgacaggtgtgggacccaggctggtaacatgagccaagcacagcctgccaggctgagtgggcacagcgagcccagcaggaccgagcacaactcagacaaaggtgccacctgccacagagatttctggccagaaaaacgacaccctaaagatctcataacacttactcttccctattgtatccgattactgactcatccctttccttaaagtacctgtctggcttctatagatgagttcattattctcactgtaatttaaatctccaactctaatgttcagaaggattccttctctaattactatagtgcagtgcagcactcctcagattatttatggtgtaaagccactattttctatttttcatgttctatttaatttagagatgatatgtggtcctattgtgcatgactactgtatggctcaccattgaatcatcactggagtttaacaacagtcagactggtatacaccctgtccaataagatgacttcactcacttaaatgtgtgacgaagacagatttctataaaggatcctgaatggtggtattcaattcctgtacctgttgcagccaatcagtaataaaaactttgtagccgtacactgttcctaaaatcacagtgtgtgtaacactggaatggtgaatttattgtattctattattttaggagtatgattttaaatgtaatgaagggcaataaatagaatctgcatttggcattttcttaatgtgtgtcttccaaaggactttatgagagtagaagatttgatcctcttaatgttctagaataactgtagggaaatatctctaacttattaaagcaaactctagtaaaggaaaccagttagcatcaaggaggcaggttacataccatggttgggagttatttgcattctgaaatgtaggatgaaaataattcatcagctcaactgtgaaggggagtcttcatgacaagaaaggggaaaatagtgaaaggaggggcagaagagctgacttctggtcccctcagtagaatttacttgggggaccatcagcttctgtggctgtaaaatgaggttggaaaaattatttcaaaggtcttcttgaggtatacagttatcagactatgctcttttcctaagaaagaatctctactgaaaatgggtaaaaggggaccagactttttttctaagttctccattttacagctgaggtcactgtggcccaaagatgataatcagctctttcaaggtcaaagcagggatgagagctggtcatcccacctgttgttgaagctctttcctctcctttatccttagaaatagcgctcaagatagaaggtgcttaatgttctcttctgggaaagtgaagctcatgtgttcaatgccaagatgttggggtcgcttggatttctaggaaagcactcacaacaacttgtgaggtctcattcttgatagtgagtcttgacaacactctcacttaacaactcactctcgagaactttcacttgtgttttatttggggaagcccagacaggttgggaaaaaagggctgattttataatgcaggtccttagacttcgaaaacctaggtcttgttccactggacgttgtgtaactgtgttgtgaacacaaatgcttctcagttaaggttttctggaaattctgactctatccactgacattgtcttaaatgtggttatggggtgatatgatgagcccaagcccaaaagtctattttttgaaaaattttatgggtacatagtaggtgtatgtatttatgggttacatagaaatgggaaaagttcccttgtccccctcacagggcatgtgatggacgtgtggctcacttcttcagtgccctgctgctcaaacccctagcgggagcatgcagactggtaggttgtggggctctgaccccatggcggtatctaaaggtgaatgtttacagatgaagcctcagtaggcatgtgttacagtatgctctttcagtttagccatctgtaggtagctcgtgttagtcagctcaattagacccactgccttatcgcaaggacagagggctttctgtatcccagggtttcttgccttggtgtactggaagaatcggatcacacatgggcttggagaacgagtgcgaggttttattgagtggaagtagctctcagcagatagcgaagccagaagggagatggagtgggaacgtggttttcccctggatccaggcccgctcagtggccgggctcttctccgaccgccccaaccgaactccgcattgttttgctggtcaatggcctgccaacctgccagcatctgccagtgcctgtcggtgcgctctgccagcgtgctcctcttgatgtccagctgcttgtttctctgcccgcgaagatcttggggtttttataagcacaggataggggtgtggtgggccagcgtggtcttgggaaatgcaacatttgggcaggaaaaaatgtctgtcctcacctaggtccctggtcacaggcccaggggtggagccctagccacagaccacaccctcccctacccagcacttccctgccctcctcccatatcaacatgagatattttgatgcaggtcttcaatacgtaatcatcacatcagggtaaatggggtatccatgacctcaagcatttatcctttgtgttataaacaatccagttatagtttctttgttaatttaaaatgtacaattaaattattttggactatagtcactgttgtgctagcaaatactagcatagaaaaactagaaagaattaatgtcttatttattctttctattttttgcacccattaaccctcccaacttcccctccagcaccctactacccttcctggcctctggtaaacatctttctaccctctgttctcacgagttcaaatatttcaatttttagttcccacaaatatgtgagaacatgtgaaatttgtctttctgtgcctggcctatttcacttaacataatgacctccagtttcttccatgttgttgcaaatgataggatctcattcttctttatggcttggtagtgctccattgtgtatatgtaccacattttctctatccatctgttgatggacatataggttgttttcaaatcttgtctattataaatggtgctgcaataaatatgggagtgcagatatctcttggatatactgatttcctttcttttagttatataccgagcagtgggattgttggatcatatagtagctctattttgagtttttttaaatatatatattttttactatactttaagttttagggtacatgtgcacaatgtgcaggtttgttacatatgtatacatgtgccatgctggtgtgctgcacccattaactcttcatttaacattaggtatatctcctaatgctatccctccccactccccccaccccacaacagtccccagagtgtgatgttccccttcctgtgtccatgtgttctcattgttcaattcccacctatgagtgagaacatgtggtgtttggttttttgtccttgcaatagtttgctgagaatgatggtttccagcttcatccatgtccctacaaaggacatcaactcattggtttttatggctgcatagtattccatggtgtatatgtgccacattttcttaatccagtctaacattgttggacagttgggttggttccaagtctttgctattgtgaatagtgctgcaataaacatacgtgtgcatgtgtctttatagcagcatgatttataatcctttgggtatatatccagtaatgggatggctgggtcaaatggtatttctactctagatccctgaggaatcgccacactgacttccacaatggttgaactagttaacagtcccaccaacagtgtaaaagtgttcctatttctccacatcctctccagcacctgttgtttcctgacttttggatgatcgccattctaactggtgtgagatggtatctcattgtggttttgatttgcatttctgtgatggccagtgatgatgagcattttttcatctgtcttttggctgcataaatgtcttcttttgagacgtgtctgttcatatcctttgcccactttttgatggggttgtttgtcttttttcttgtaaatttgtttgagttcattgtagattctggatattagccctttgtcagatgagtagattgcaaaaattttctcccattctgtaggttgcctgttcactctgatggtagttttcttttgctgtgcagaaactctttagtttaatgagatcccatttgtcaattttgtcttttgttgccattgcttttggtgttttagacatgaagtccttgcccatgcctatgtcctgaatggtattgcctagtttttcttctagggtttttatggttttaggtctaacatttaagtctttaatccatcttgaattaatttttgtataaggtgcaaggaagggatccagtttcagctttctacatatggctagccagttttcccagcaccatttatcaaatagggaatcctttccccattgcttgtttttctcaggtttgtcaaagatcagatagttgtagatatgcggtattatttctgagggctctgttctgttccattggtctatatgtctgttttggtaccagtaccatgctgttttggttactgtagccttgtagtatagtttgaagtcaggtagcgtgatacctccagtgttgttcttttggcttaggattgacttggcaatctccttaagctgataggcaacttcagcaaagtctcaggatacaaaatcaatgtacaaaaatcacaagcatttttatacaccaataacagacaaacagagagccaaatcctgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatatatatcgtgaaaatgtccatattgcccaaggtaatttatagattcaatgccatccccatcaagctaccaatgactttcttcacagaattggaaaaaactactttaagttcatattttgagtttttaaaggaaccttcaaactgttctctagagtggttgtactaatttgtattcacaccaacagtgtacaagtgttcccttttctccaaatcctcaccagcatttgttattgcttctcttttgggtataagccattttaactggagtaagatgacatctcattgtagttttgatttgcatttctctgatgatcactgatatttagcaccttttcatatgcctttttgccatttgtatgtcttcttttgagaaatgtctattgagatcccctgccagtttttaaatcagatcattatatttttccctatagagttattcgagctccttatatattctggttattaatcccttgtcagattggtagtttgcaaatattttctcctgctctgtaggttggctcttcactttgttgattgtttccttgccatgcaggagcttcttaacttgatgtgatcccatttgtcactgtttgttttggttgcctgtgcttgtggggtattactcaataaatccttgcccagtcaaatgtgctagagaggtttcccaatgttttgtttttgttgtttcatagtttgaggtcttagatttaaatagtacaatcgcatggagaaccgtttgtaggttcctcaaaaaattcaaaatagagctaccatatgatccagcaatcccactcctgagtatatacccaaaagaaaggaaatcagtatattcaagagatatctgcactcccatgtttactgcagcactatttacaatagacaaaatttggaagcaatataaatgtccatcaacagatgaatggataaagaaactgtggtacatatacacaatagagtgctaccatctataaagaagaatgagattctgtcgtttgcaacaacatggatggaactgaaggtcattatgttaagtcaaataagccagacacagaaaaaaaattttgcatattctcacttacttgtgggagctgaaaatgaaaataattgaactcatggagatagagagtagaaatatggttaccagaggctgggaagggtagtgaggtgctggggggaagtagggaggattaatgggtacaaaaatagaaagaatgaataagacatagtatttcttagtacaacagggtgactatagtaaaaataataatttaattgtgcattttaaaataatgaagacagtatgattgtattgtttgtaacacaaaggataattgcttgaggctatggataccccatttaccctgatgtgatctttatatattgcaagcctgtatcaaaatatctctgtaactcataaatatatacacctactatttttccataaaaattacaaataaaaaatcctaaaactcagcccttacaagatctgcaggggagacagaatttgtaggttgatctcccaaattcatcaggcttggaaaggaccttagactttctgcataactacattagcaaaaccaaaccaattctatggaaatgccaatattaatagaacaaatattaatactcctcagagggagatagcagagtctttacactatatgatccccattgtccaatatgcaataaaaaaattcaacatgcaaagaaacaagaaaatatcacctattgtcataaaatcagtagaaacagacccaaaaatgtccagttgttaaacttcatagaaaaagactaaatcaattattatgtattcaaagaacaaacagaaaataggttcaaagaatgaaaggaaaatatgatctttataaatgtacagatagtgaatttcagcagagaaatggaaactataaaaataaccacatggaaattttagagcttaaaaaattatagtaactgaaattaataacacactagatgggctcacattagtttggagatggctagcatcaaatgagcttgaagacagatcaaaagtaatcatccaatctgaaaaaaatggaacaaaacatgtatctctaaactttttaaaggtgttgtattgacttcttttgtatgagttttttaacataagaaagtaataactctcttggtacttcaagctagactcacgttttcgattctccaggacaccacctttggggttccccactgtagctaaaagggacctggctatggtaacataaatgggtaatcaccttggcagaagtgatcttaacaaaaatttcacttacttcaactaaagattcagtaccatacaagcactgagaaaacctcactcattctctaatgttcagctgagcaatcacatactgttacacatttgtcttctaaaagtcatacatacatagcacagtgctatgattagatacctggactatggttatggagtgcctggatttaacttttgactccagtacttactaactgggtgactgtgggcagactacttagtttgttcatttgtaatatggggataataatattatacacctaacacatttggagaattattggagaggatatatgtaaagcacttacaacagtgcctggcacatatgtgttcattgttatcacgtttctcccaggttttttaagaatagagattttcaggggtagaagaatattaaaagagtgaatcacctttaaaacactggtgtaaaaaatacctcatgtcaaaaaatgtttaaaatgtgctttagatgaaacctgttacctttcccctgctgatcaacagagacattcctttttgaaagctcagctttagagatactgccttcttcttgaaatagctgtctgcaacagataaacattactctgtgctactgggtgtgttcaatgtgtaaatagattgtgggaatatgagaggctggtttttcaagttcctgctccaagtagttcacaagggtcaagtagtccagcattctacagtttgtgtgtttgagagaaaaataagcccataaaaacattctaaccttcagattaaggtaagactaatgcgtttagggatctccagtgtgatatctgatttcttaatttctgtattttgtgtgtggtaggggagtagtgggatttgctggtcaggaagaaaacagctccttccaccatttgatattgtattttacagtaaaaaagggagaaatatgtacagaagggacattttggccattggtagctatgagtttaatggattgaggagagaaatataagtatctttttgttattaacacttgattctatctatgaagtgaagcattgcactaggttctactgaagagtgagtgcctccaggaacaaatatgcattctagtgacataaaaaaatcaaattcacagcagaagtgttgcatcattttgctataaatctctcacacctctctatataaacctctcacatctctatataacatagattgtccttttgctctgaatttctttcatttattagaaaatttagatgtttcatttggaattatttaattgtttttacattcagttccatttttgatatggacaaatatccagtatggatataaattcagtagaaggattaataaagtctgaaaaacctggaataatttcaacatgaatatgatactgtaacagcttacagaaatgcgatattaactgtgaacattaatatactctgaaaagatgcatcagggtttaaaaaatttctccttaatgtagattgttttaattaccaatactgtcttcctcatttaaatgaaaaacgtaattttacaactattaatatataacttctctttgctccaagtatatgtgtatgcctggagaaaagcatatgcctggagaaaacaggagttatatatttatagcattcaaaatagtataaaatattgtttacatgtaataatgcatttagaagtactacttcagtagtagcctccttaaaaagtattttaaacacaggaattaagtatataattttttcattttgtaataagttgtttatatgttatttggacaacagcttacacacaaaagtgttacaattcataccctaggtcttaaatgcatgaagccatttgtttggactctagtgaaatccttaaattggtccttgcatccctcagtatatatatgtacatacccacatatacatgcatatttacatgtgggcaactaataactgagaaaatgtcttactgctcttttagttgttgaatcatgctttttctatgtatttatgatttcctgaaattctttgctattttaagtttgggtattagctatgttatccttctatttattcagatttgttaaagtcttctgataggtttagtgaataaaattattgagcttctacctcttttcttttggaggcccatttagtatttttgttgaaattacttccttattattatttagtatgttaagggaaggaaaaggaaatgtagctttaatatgtaaaatgagcagttcgttttacttaagctctattatatgatgatgtatcttatgactattttgccatcctgcgtaagcacttagctaatcatctttaatacattctacttaaaatctacttgtaaatatgcttttgtacattcatatcttacttgtctgtggtctctcatcctctttctctctcacccctctatatacattcacacattttccatgatttcacaaaacttctctccaacctcgttccattcctggttatctctttctgtggggagtatcatcatttcctttgacctctgtttctctacatcttccatcttgcttagcccatggacttttgattttactgaagacagcaaaaaagcagatggtgcttctgttacttgcagagttagcaaccgctgtggttaccttaggttctgaaagattatctaaaatagggaggagctcctagaggaacaaaatataataaacatgtagtgtactgggataaaaaattcacttgatctggtctctctctccttttaacaaaaacatttctctaagaagtgattaataaaacataccctactgcctcactttctcttttaaaatctttctttcaaattcccctatgacataaaatcaatcttcatcactttattgacactgtacttccaagggtcacctgtagtgctgctaggaaattcaagtacattcatttatttatgtattcattcatccattcaataaatatttatttagtgacagctatgcatcaggcattgctgagcactgaagttacagtagggaacacttaagtctgcctttatatatctccagtctagttaggaagggtgttaactcacccaaataattcattacaagtgtgataagggctataaggaatacttttccaaattctcattttattcatccccttggctctatgtgacacacatgatcaattcctacttcttaaattttctctttccttcttgtccatgactctatactatttattcaactgcttttctaccacttcccttcttgtctatttttccttttctcttccttaagtttgggtttccctcaaaggtttagcatttatttagcctataacctattacgttttgcctttctctataacttcttatcaacccttagttttaaatatcacctctaagtggatacctccaagacttccatttccacatcttatcttttccatctgctatacattttcccacttgtatgtccaagggtcactcgacattcatcatgattgtagccaaactcacagcttttatgtcaaaccacttcccctttcatttcatttgtttctgtgaatggcattaatgatctcttggtttctcacatttgaaatcttggagtcaattttgcttctaacttttcctttgctctcaatatccaaaccactaccaagtccattcatttctttaattataatgtatctagaagccatcctctctcatctcccttttctgttatttttttcttttattctctattttctcatccttttttccctcagtctaagagctacctacaattcaaggttttggtcaggccccatctccatcagaaagtccacacctcatggatatcttctttttctaagccccagaatcattggggtagtgaaaagaacatagccaaagagccaggtttaagttttgattctaccattcactgccccctgtgcactctctgtgaaccacagtttcctcagactcattctatctcatatagtggccacaggaacaaatatagtcatggagaggaaatcattttgaactatgaagaactatatagatattaaagtaagatttgttgctggaagaataactcagtagcagagaccaaaaccccaggtcttaactattgaaatcatattgtgcaggggttgagagtgttgactctgcagtcagatgacctgagtttgaatctcagctctgctacttaccagctgcatgaaattgagaaaacttagttagctttcctgttgctgagtttcctcactgtcaattggggataacaatagtttctactgataagagtgttgtaggattagaacgtttagtaaatgtaaaatacttaaaatagtgcctagctcatagtaagtgctctgcaaatgtggaagaggtggtaggggcctatgaggctaagtgtggttacgaggtgaaagccaggtattagaactgagccaccagatggggattaggtacagcaaggatgcaagcacagagctacagactggacacatgtacctagatgaatccctcatgattcagataaaaaaaagaatgatcttgccatttggggcagaactgagcaaatgatggaggtatgaacgttctgagcgaccattcggggcacaaaaatggggataacagtctttcagacacattttctttttgttaaagaagaacaaatgttagattgcccttttgtgttgtgaaatatgtcagtatatcatggaatcaaaatgtcagtatccaaataaatgtccaaatgttgagaaagctgactcaactgtcctctatattctagaaatccgtctctttaacagtcatatgcttattgcatttcagaggacaagggcccttagaaatgtcattcctcacaatttataggattattgcccaaagtgtgtatttttactaatacacttggagattagtttgtttgattgtttcatgtcagaaagaaaaataataataatacttagaatattctaagggttgttctaagtgccttaaattttttaactcatttaatcttcacaagaacctcatgagatgaacatcatcatcatcaacatcatcgccactaccatttacataagaataaactgaggatcatagaggttaattggtaattggaccagatttcaaatccaagcagcccagcaccagaggcaattttctcaagcactgagtgctatcatatcagcaactctgtgttttagaatctggttaaaagggcatgctctggagtcctagactgctgttacatgttgcatctccagttttccttgacaagtggtaataaatgtttgatatttttcataattgataaaaattacttacataagatttatactaagtaatccaatgtccagtaatgctgtgcaagaagagtctggtttttctcatccattattctgtatttgagcatcaaacaaaggcctcaaatactgatgctctctgtttcctagagagtatgttatactgctggccgggcgcggtggctcacgcctgtaatcccagcactttgggaggccgaggcgggtggatcacgaggtcaggagatcgagaccatcctggctaacatggtgaaaccccgtctctactaaaaaaaatacaaaaaattagccgggcgcggtggctgccgcctatagtctcagctactcgggagactgaggcaggagaatggcgtgaacccaggaggcggagtttgcagtgagccaagatcgcgccactgcactccagcctgggcaaaagagcgagactccgtctcaaaaaaaaaaaaaagagagtatattatattgttttgccctgtacttaactgatgttgtacccgtgtacttaactgctgctgctgcccgtggggatattttctagggtatctgtgagtttccatctttgtctttgctaactatttcaaaagttcaggctcaatttttggagttgctatgtttgttttctatttcctattttaactacttcttgttcatttaaatgttctctcaccgtagtttagtgggattttttttttttacttttctctaagcgttagctacaaaaataacttaataggcttttagttcattttcttcttcactgaataagaatattaaaatcaaatttaccttcaccgaacacttaataacttttttcatttccaagaaggcccagtgccatttgtaactcttgttaaagtttaatttagcagtttccaatttttgtaacagtcgacttatccaggctaatttgatttaatatttctaacagaatgccaggaaacactctgttcctacaataagaacatgtctgattcatttaaatgaataagaacacgtctggttcatgtaaatagacttcagcggcatttttgttttggtgttgtgcagtcaaaaaatatttccgagagaatatcaggacttggaaagaaaccaagaaaatgaatacaaaacaactctaagatacatatcattctaaagcaagtaaaatcctcaagaccaaataatataatttaaacaaccatttaacattgataatgtttactaagaatggaagtggtagactttaccagaaaatatagttgagttggggtgggacgtgggggtgtgcaatagagaaaccaaacttggaaagaagccatcagataatgatgttccaggttcaaatataaactttaaatccaaatatacttttatctggattataaaaacgaaagttcagcaacagcccactttgtaaacacagaacaagagtgatcatatcaaacaggtttacttaatacaaatagcagagtatagacaaatccattaatatatccccctaagagctatttatgtacaacaatagtcttctctccctggtgtgaagttacattaaaatcagtatatgattaaaatttttgaaattgatttcattaaatcaagtgacattatatcaaagatcagttttcaaacaaagcagtaagagcctattgcaaaataggcatttttcccaactttcaacagataatggtatatccaaagatgtctgtggccacaaacaaatgtataatttttaagttgcatattttgactagaactagatatgtactaaaaaaccattttgtgatgaagaatcacttcccactaattgagagaccagcacagggagaatactattgatcttaaatacaaggaagtccagacattaatatggaaaaaatatagattgggatgtcctgtttgcattagccatgttcaagaaggaagaatttaatttgctttgaactactcacagctgccatctaattatttttgttgactgttacagagtttgagctccaaacacaggaaggttatttctaaatcagttatacacaacaaccaaacagctattgattttctttcaagtgaattcccatctgactcttattgttcttgtgaataatagtcatatgtatggctttatacttaagcacaataggatataactaaatattggctcaactcagacctaaagagtaggttcctgaacagtgagaatatcatctagtgataatctttcactgcttatactgggaaaaatgttgaacctgggtcagcaaacatgaaatgtaggttcagtactgctcctaatgataatgccaaaggctcacactttctgaggatttaccgtgactcaagaactattcaagtgttttctatgtaaccaaggcatacagaggttcagtcatgtttctcagaaattttagagccaagatttaaaccagagttcctgctttgtaccagagtcactttggtcagcttaagtaacttccaaaggcatcttcctggggtattttttcctgctgcaccaatttttacctttcttcctgattctcaggctcactcaatctatactggtatctgcgaacctgtcactgacctcaccccatctccagcatctcactgattggtttcctctccatgatcttttcttaaggggaccctgcattctttgggcccctcatcattactcaaggcccctagatctactggccccctcagtcctcctagtccctcaaccaccaccaactcctcctctcctagcttagctcccccattcctgctcacaggagccaggtagcatcaggacctccccaatctcattttcctctctaccctctccacactctgactactgtttcagcttttatttctttctttagtcagggcaatctgctctgatgtcatatcctacatcctctctacactgtcataataaaactcttttggtatgtacaagtgtgtaccctccaaagcaggagtgctgggcactggtataaatttgaccaatacaaaattaaacacacacacacacctgtgtgttatgttgtatattatgttatatataatattgttgtgtgtgtacatatatgttatatgtatgtatatttaattctacagtatattatagtggtcaagagcacagtcaatagagtcagaccccttagtcagaatccagcttcaccacttacaagctgtgtaacactggacaagttacttaacctccctctgccttggttttcctacctgtaatatgggaatagtgaaagtatctaaatcaaataattgatattgtaaaccaaaaggtatctgagacaggtctcaatcaatttacaaagtttattttgccaagattatggatgtgccagtgatacagcctcaggaggtcctgacgacatgtgcccaaggtgattgggacacagcttggttttatacattttagggagccgtgagacatcaatcagtataggtaagatgaacattggttcagtcaagaaaggcgggacaactctaagcagggagggggcttccaggtcacaggtagataggagacaaatggttgcattcttttgatattttgataagcacaatttacaggaatagtcacttatgccttagtctggcttagtgaaaaaacagggcaaaggaagcaatcagatacacatttgtcttctgtgacagagggatgactttgagttctccctgtcctttgtccacaagaaatttccctgtgagaaaaattgtgagggaggtatgtagcttttttatctttgtaggtatcttatttaggaatagaatgggaggcaggtttgcccaatgcagttcccagcttgacttttcccttcggcttagtgattttggggtccagagatttattttcctttcacaatgtaaagattgtactgttcatatatgtaaatcaagaattcataacagggcctgaaacttgtatataagtgctgagtgttcactatcattattaccatgactcataaggaaaaagcattaaggcaagtataataatggagcaggaaatatacatttaagtggaaaatatagtacaacatggataatatgacatgtgtgattaattacgacttgaataatgcgaagcatgtaattatttttggctttgcatttgatatctgaggaatcccaccatttcacatgaaaaagtgcatgtgacaaggaatcttccaggaattttgcattagaagttccttttgatcctcctcaaaaccctgtgaagttagtactattattatctccaccctgtatgaaaagaaaccaaggttcagagaggttaagtaacttagtttctgtaacatagtaattgccaaagctaggatttgaatgcagagcttcctgactccaaaacctgactctttgcaattctccacttgaggtgtccattggaaccccataggacgttaaaaaaaatccatggaacacaaactcaagagattctgtttttttgaaaagcagcttttgtgagatataatgtacatactgtacaattcacccatttgaagtgtacaattcaatgtttttttttttttagtctattcacagtgcgtttagccatcaccacaatctaatttcagaacactttcgctctgggcgggcatgtccacagaatccctggggtcttaatttcaaagccacagaccttgtaggagtcttgaatgaacttcaaatgatttgtgaactttttctaggatccacagctttcactatcttctctaaagtgataaaaatataagccaaaaatgtattaagaaactctagaccagaatggccttgaactttaaggtacaaatcactgggggaccttgttaaaatttagattcaaattcagtagctctggaatgcgctaggcctactatcattaattttaatgataggaatgctcactttaagttagatgttatgtgccctaaaattccattcttctctttagtagatctatgctatgaaataactgcactcaattattattgttatatttttaatgtcatcggtaaaatattggcagacatttattttcttgattgatgcatacttatccacaaaatagctatggttttggctcttggcgcaaaaagtctaaaatatttactaattgttccttaatagaaaaagtttgccaacctctaatatagaccatgggggaaagccacctttaaggagcagaaatgttgttcatcttactctccacagctccttgctacatgtggcagacatgacattatcaatcagacttataggaatcctaaccaagtatgaggggcagcaagctggctatatttatgtataactcctcctctagaggagaaatctgggcagatgagggtcaacttcacttttagtttaaaaatacatctccctagagcttcaagctgctctcctgggtgatagcatgggtgggtgtccacaaaagaccttcatgcattttcagttaggtcatgtctctatgatcttggaagcaagattccctaagagtagtctgcaatccatatagagagcttggttaattgggtttggatgatggttcaccaaacgtacaggtagaatattttatcttcttacactcaccttcaagctacttacattaaggtgtttgttcagaacattgaactttcaagagctgtctgaccatgcatttcatatgtatgaaggcatttctgcttattttccaacactaactcactttgaatgctgcaaaaatgatctatgctatgttaatgcctgaatatgcatgacttcaaaattctccaggcttcaggtggtctcctgcaccataagcctctactgcagagcatcctcttagacatccatcttgaactattttttccttatgtcttagtctatgactttagatctcctaactaatggttgatttttcagccaattttgttgttgttgttgttgttgttttttgatgcgagaggttgcccattctcaaaacccacttccttcttccaaccaatgcccattgctacaaggcccgcaactgtgttcagctttcagcatgctccaggggaacaagtacaaagtctgacctggatggaattagattatgcaccaaaataattccaggatttactaatttatatcattagaaacctagaatgttaggccaaggaagatgtaatataacactggattaggccaaatgtattgatatggtgcatttttcagagattctggatttagtgtgatacttcttgcagctggaggtgttgttaacagtttacttgattgtttagttgaaatgtgaacttagcaatgacctacatcattgactctgtgtgatatacttgactcccagttcattagacttaactaactgctcctcccattctgttgatcatccctcttcagtctctttcatcatctcatttattcctcttgtccctggaccaaaccgaagatcaggctgcttattctcatggcccgataacgagattcagataagctgggaaagaaggaagtttatttctgtaaccggctatggctgaaaaatatctccagaccaactcaaaattacaaagttttttgactttgtaattttgagttggtctggagatatttttgacaaagagcttatataccttctaagctatatgtctacatgtaagtgtgcattcatctaaagacataagtgatttacttcttctattctataactaagatctgactcctaaagaccttcctctggagcctcagtaaatttacttaatctaaatgggtccaggtgccggcggtgattacccttatcttgtctcctgctaaatcatggaggtctggggagttccttcagacccccaataaacttgtttgtggaggtctggggcgtttcttcagacccccagtaaagtttgttttatcctaaatgggtcctgttaagaattccttcattatcttgccatacttcaaggcccaggaaaggcctgggcaaaactcttggtgggcttttgttaccttccagcctttgtataagggcactggctctatcagcttttaatatttaacttcaccactcagtcagtgctgaaacagttgttatggaggcctgcgttagtgagacctggcctgccacactctgtccattctttaaatattgttgcttctcatgattctatcttttgcccctttcacttctcttcctggtaatctcacttgcttgcacagcatcaaccaccatccaccatcgaggcaccaatgattcccaattaaatacctctagtatagacatctgataagctataaacagtttatgggaagtttcctattctaaatgcctttctggacaggtctttgttgttgcatcataagtacctttgttgttgcaccataagtatccggacctcaacatatctaaattgcaattaattatttttttttctctttcaacgttttttgtcttgtactctccatcactgtgaacagtattatcatcaacatttctaggctttacccccgtgttactgaatcaggctctctggagatagacacccagaaatctatttttaacaatatacttaggtattcttatgcacactaaaatttaaaaacctttgcagttccccatgctggaaacctcagagtcattctcttttctcttccataccacccacatcgaagaggtcactggatcttattgagattattctaaaacgtcccaaaagtgactcttattttccttcccactacacagctttagttcctaatctctccctggcacttctgcaagagcctcctcattttgtctacctgacctttcccctgtctttcatccaatcactgagtgctggtctttcaaaaaacaaataaaaaattcaaatatgattgcgctgttccttggctttaaagcttcaacagcttgatggcatgagaacagttttcaggcttcttaaggtcatggaattctttcttcaaataaaatcctaccaggaaatctaacttatagaacagatgaaaacggagctgctctgtttgaagcagtcgtcggcgccacaggcttggccactcagcctctttcgctgtgtttcctaagaaaacattcctgaagatacagtttgaaaaacactggataaagtccatattctttgtttggatgccaaattcctcccactctgacatccccctttctcttagctttccaatattaacccagaccccagacctggagttagtcactatttcttctggactagttgtgtgttcttatgactttttcacatttgctgtctctacaacctagaatgaccacttttttcttcctaattgttttttcctttgtgttctcaaagccaaaattgggatttatgaaactgtgattttatgtttatgcttgtctccactagaaaataatagaaaatagagaagccccttgaaaacagaacctatgcattcttcatgaatgtatcccctagatccagcacagtttctttttttgttttttatttgtttgtttgtttgtttgagacaaagtctcactctgtcgcccaggctggagtgcagtggcgtgttcttggctcactgcaccctccacctcccacgtggagggtgcctcagcccgggtgcctcagcctcccaagtagctgggactacaggtgtgtgccaccatgcccaactaactttttatttatagcagagatgagagctcattatattgcccaggctggtttcgaactcctgagctcaggtgatccgcccgcttcggcctcccaaagagctgggattacagacctgagccacaatgcctggcccaacatagtttctgacacatgattctatacgtgtttactgcacgaacatttatatgctctataactcattctatctgttctttggttttatattttcttcagaccgaacatgtctttttgaattaaacatcactttaggaactagatgtattaacttcaaagctatatgacactcatactgttctttgcctgtgttgtagcctagcatgataattattgataatcagtggatatatgcattgtgcatcatgacatatgaagcagaggtaatatggctataagatatttttgacagaaatgccatttgctgtatttttttaactgattttatatgtaacatgtattcattgtaaaaacatataaagaaaattataaagaagatattaaaatacatttataactatccagaaatagacttaatattttggcttattttttctcattctttcttctataatacatatatgtgtgtgcatatatatatatatatatatatatatatatatatatatatatttcttttaatataattgggaccatactgcataagtaattttgtatcctgagtttttttcactgcctttgtattgtgagccttcaagcatgccatcacatataaaaagactattagtattattaataatggtattaattaaaaattatgatgtttctaaggaattgctaagatttataaattcttaatagaaagtctaggaagccagagacctctgggtattttgtgaatcaaagggaatggaggtttgtgttggactgatgcattttaatgacgtattgcttaacttcattgagaatagaaacgatggaggggtctaaattttctgagcatctgttatatgccaggcattgtgctagacactttttatacattaactcattttaatattcaaatgatatattcttcaaacccaggaagtagatattaatatgcccatttaacagatgaataaactgagatgcaaagacaaagtagcacatctatgttattatctcagggagtagaattttaattccattagtttccaaagcccataccctttcctctaccccacactttctccaacaccaactttgagagggtacacaaagtcagtcttttattctgaagatgttgtattagcagtgcttaccctgtggaccataagcccttgggtgaccacagtttataaacccctgaaattacctccctttgtcattagaatgtatatgtatatttttgaggtagagagcctatagttgtcactgattatctaagggatcaactgttcccaacaatgtttatgaatctctactgcaaataatgggatgtatacaagtattgcagaagccctttgaggagtctttagttttgcttgtcaggccctgtggtgaggggctatattccaattttcattttaggcatcacttctcaaatgtcttattttgcatttaattcataaatttattcatttggcaatattttcaaatacctactatggtgccaggagttgtgaggtgttaggaatacagggctgatcaagacaaaacgagatatcccacagagcttagacattagcagggaaaaccaatgcatgttggttaaaatcagcattttaaatcagcatgatgagtgcttggcatagtccttagcattgttcaccaaatatttacgatttcttcctcttgtaggcagatggcaggataccatttactggcccccttgtaattgggtagggctaagtgaccatcagttctgtttaaggagttgtaagtagaaataatgtttttcacttccaggccaggacatttaattcctactatgaaacctttcagaactcttttttccctctggtgtggcaattggcagtgttcaagatggtagctccctaaacagcctggattcttgagggatatatagcatggccaagaaatatgaaataaacctgtgctgttacaagctgttgcaatttgcgagttatttgtgtcacaacatagtctaccccagtactgctcaaaatgtctgtgatgaaggatcaggttgtttgttacttttattttcaacctggatagaatagtatttttgcaaaatacaatttaagtaaattagcagataaatgagacatgaaatacataaacattcaagtacaaattttcatcagattcaacagatttaaaattactctgtcaaattactataaaaatttctaaatgcttattcttaatttctttacttatataattgcaaaccagtaagtttacagacctgcactggtttgcaacccaaactttgaataaagctgtattagcctatcccaactgatacagtgttactgtaagagaagtatgaaaatgtattggatagatactatgagtttccaattgctgctgtagccaatcaccacaaacatattgtcttaaaacaatacaatgtattatcttacagttctgaaggttaaaagtccaaaatgagtcttgggagactaaaatcatggtgttagcagggttgcatttcttctggagcctgcaggagaatctgtttccttgtcttttccagcttctagaggccatctgcattccttggcttgtggctgttcctccaacttcaaagcccatcacctcagcctctgcttatgtcgtcacacctgcttttctgactttaactctactacctccctcttgtaaggatcattgtgattacattgggatcacccatctaatccaggctaatctctttatctcaagacctttcacgtaatcacatctgcaaagttttgccatctaaggtaacatattcacaggttctggggataaggatgtggacttctctgggagccattattcagtttatcatagatagctaagctaaactaggagtcagccatttaagtagatccctgtggatacttaggaattaggagatggagaaatgggggaagtatcccaggcagagtcttacaaataggaagatctggaggtgaggaagattatggcttttttagaggaatgaacttttgagtgtggttagaggatagatacgagagagagagatcagcaagggacaaatcatgaagggttttgtaaaccatattaaacaacttgaactcttaaagagcaaagggaagacatcaaagggtattcagtataaaagcaacaattatcaatttgtattttggaattgcatatagaagagccagattggaggcacaaaactatgatgctgatgaaccacggtggtgtcacctaattcacagcatgtctgaaacccaaatccattatttcccacaaaagccagcacattctccatcttccctattgttttcttctaggattcaattcttaacattatttttagcctctttctttctttggcttcttactctagtcagtcaccacaccttattggttcttgaaaattttttaaagacataatatatggttacatgaatacatccaaaataataaacaatatggaaataagtcccttttcatcccttctctgacccctaacaatccaactctcatcttcatatgcaacctgattcattatcaatatgtattatcctgtgccttttattatgcatttacatttattatgtacatgcatatatctactgcattgttttaaaagcatttgcattaaaaagcataattatcttgtctattttcagctcgcaatataacttagatattttccatgtcaatatatttattttaaatgcctcattttaaaattgaacatcggtattgctctcttttccagcttcgagagcttctaactctaatagattctaacagtttctaactttagactattacaaactttatcttataacttatttttcaaatctttctcttttgaaatttttattaaggctttctcttagccagcatttttaaaggtagaagtagtcttctctttaaaaatatcaaaatacacaatgccaagaaaataaacagtgatcttaaatattaggttggtgtaaaagtaattgcagtttttaccattaaaagtaatagcaaaaactgcaattacttttgcaccaacctaatacctttttccaaactgagagctctgtgaaaattcacagtggacattaaagactctgagaagttctgtagaaaaaaaaatatttaacttggtttaactctacatatccaaattttttgttgaactacatcacttgatatggtttggctgtgtccccaccctaatctcttgaattgtagctcccacaatccccacgtgttgtgggagggacctggtgggaggtaattgaatcatggaatcatggggacgggttttcccatactgttctggtgatagtgaataagtctcacgagatatgatggtttaataaagggcagttaccctgcactcgctcttttgcctgccaccatgtaagacgtgcctttgttcctcctttgccttccaccatgattgtgaggacccccaccccagccatatggaaatgtgagtccattaaagctctttttttttaaataaattacccagtttcaggtatttcttcatagcagtatgaaaatggactaatacagcactgttaacaattccatataatatctaataacatctcatgggatactgttgttccatgaagtcactgtgtggcctcaaatgtagtggttacaagcagggtccctgaaaccaaactattctgaattacttaccagttgaccttgggcaagttacttaacatctctgtgcctcagttttctcatctataaaataggaataatagcaatttgtttcattaggaagtcataaggattagttgaataagtgttagtggttattatttggagcattctgaggatactgctcttgaagtattggtatgaagttgatggcactgttagcctctctactgttatttgaagaatccatatcattgtgaaattaaaaaaaaaatcttgactatggcactcccatataatgtaccacacagaattgcccgtgtgagaagaaacagctctgttgcaaagaaattcctgtaattccatagcatctctctttgagtcattcagtttggggttcgttgtaaaagtactacttttttctctatccacagcatgacagttcttaccttttgacagtcttgtggactgctgtgcttgtggtaatccaatcacagctgctttgcaggatgactgctcctctatttgaaaggcatcctcaagggtattttgcgtatgtgatttagcttgtattctaagcatcctaaacatctctgtaagtgtgctgaaaattcatctaatttgtattgtcacatggtgacagtcaaacaggaaattaactttatttctattaatttcatcctaagagcactctcagaaacattctatatttaaagctgcatttcaagtacacagtaatgagatatattcagatataccctttcctttgattcaaatatcggcccctattatttttaggtgtgtgttactcaaaatagatgctttttaaacttatgtccctttgtgatgctatgagagtatttgactaccacatctttttgataatcagaagttaatgacttgtccaaagttatctatgctgaaaggcaatagaatgacatacaaagcatcttgccatctttctaaacagcttagcatagttcaacaaagttactggccacagagggaaaaatctacatctatatttaaagagagagatctgtttaagttaggaattgaacaataaaagaaaaatgaatttcaccctcctaatctgactagtgtttactagccccatttaactaaaagaatgaggatcaattactcatttttttctctacttgattaaaatgtgtaatgggtaagggattctccaggtgaggtatgaaatcgctgaaaagagacacacagtgatgatatatcctcaggtgaagtcattgcagtccagatgctggtcttcagtgcaaaggctgaaaaatttgatttggttagcacacagcaaacagatctgacatgggttcaaactaaaccaaatatggagaactccatagacaggaccagaacattcactcctgaagggagagctctatgggaagccaacttataatcaaaagtgtctggaaggaagtgagattgagcaagggtaattagctgtatgatttgagtgattcgtggcatgaaaatttctcagaatgaggctccatcacctagcatggaacatgcgctacagggaacaaacaactattttcattttcattccctttctctagttggagtctggatgggcactgacatcacctagctccttagatcttccttgtctatgccttggttcactgtctccttttcttcaccctgtatttctccggaaggactgcgttatcatcaactgcattctatcttactaaatttatagtcatagttcagtgctgccttctggagaaaacatcctgattttcttgatagagttttgcctacttctgatctccttagccaactgttactggaaaggggtcccgatccagatcccaagagtgggttcctggatctcacacaagaaggaattgggggtgagtccatagagtaaagtgaaaacaagtttattaagaaagtaaaggaataaaagaatggctactccataggccgagcagccccaagggctgttggttgtccatttttatgcttatttcttgattatatgctaaacaaggggtggattattcatgcctcccctttttagatcatacagggtaactttctaatgttgccatggcatctgtaaactgtcatggcactggtgggagtgtagcaatgaggatgaccagaggtcactcttgtcaccatcttggttttgcagcttcttcactgcagttttatcaacaaggtctttatgacctgtaccttgtgctgacctcctgtctcatcctgtgacttagaatacttaaccctctgggaatgcagcccagtaggtttcagcctcattttacccagctcctatttaagatggcattgctctggttcaaacacctctgacattttccccttcccttttacaagagaatccttaatcctaagggttgcagaggaatgaagatccatcttttgtaacttcttcatgctgaacaggggtgatgatattcctgcctaactattagggtctcttgtattcagagtagagaggagctcagttggaaagtgtcattacagtgagggccattcataactcttgagttctgacaaaaggtgatatctggaagattagtaagtgttcaatttaagaaaattttcagtaaacttattttgcattattacacaaagagtacaactgcaatatattccacaacagtaaagcaaaataagcaaaattatcccaagtaaactaaattagaaggctttccatgaactgggcaactgttggaaacaagctgatatggagtcactagccaattccaatatgtgcccagaattataatattgaaccatatttttacattacacagcccttttgtttcttttgagatgcagtcagacatcacgaattggttaacaggaataagcagggtcagtctaaattgcaggaaaaaaacgacaacaacaacaaaaaacaactgataagactagaatttaataacagaagtaccatacttctagaaacacaatttttctctgtctagttttccatttgtattaaagacaaatcatggtaagaccaatttgattgcaaaataatccttagtcttatatttaggctgattatttgtataaagtgcagcaagaataattatttttcacataggctttttaaattggctttgatggaattctgtcccataagaaatctcaaataagaccttttttttaaagccaagcccagccatgggtttatatcctcaaatacctatgaattaattcttcttcttttttttttttttttgagatggagtttcactcttgttgcccaagctggagtgcaatggcaaaatctcggctcactgcaacctctgcctcccaggttcaagtgattctcctgcctcagcttcctgagtagctggaattataggtgcctgcccccatgccttgctaattttttgtatttttagtagagatgggggtttcactatgttcgccaggctggtttcaaactcctgaccttgtgatctgcccacctcagcctcccaaagtgttgggattacaggcatgagccactgcgcccagccaattcttctcctcttgaggtcccaagataaccttcagctcctggacctattagaaagtgatattctttacttaccacaagtcagaaaccctgtacagggaatgtgtagacaagatataaggtcagttttcccaaggggcttttattggctctacaaatcaagtttgattccttaaaggaaaatgcatcattccagtcaaagccttggtaaaataatcagtttctccaattgtgtcctgttgcaaaagaaaacagattcttattgtgcttatgcaaataactatattgccataagttaagaatactcacaaataggttccaattctggagaagtcaggtagagagaaacaaatatgcctcaaattttgttcacaagagtacactttactcaactgttaaaagctataaatagctcaaaagaagagttttcttgtctctgaaaaacaaaacaaaggatcagcaacgttttaagcaaaaagtcaaaaagatcactttggtcttctattagctcaatccatgcagttaactcctgtcctgcttgatatttattaacatttcagcttttcatgagagtcctgaaagtttttttctttattctaatgtcataatccccaatgttatcagaaacctgcattcaagaacacctgttaaagtcctttagctgactataaaccaccttttaaataggattaaaataagacaacaactgttggtggatgacaaaatgtcttagggcagtcacagtcaaaagatatgattgacaaagcaatttgattacctcggtggcaatgttgacaatgtttcctgtatgatttttataccaaataagccaaacgtcatttttatattagtgtactactaatgttaaaccctatccttaataaaactttatagatacatctaaccaattttaatatttgaccataaggtaagattcttataccttttataactctttacaaatttatgttaaaaagtagattagtgctctaagaaaaacctgttgtgcttatattccaatgttcaattcatggaagaactgaataatacccctttaactttagccaatatgttcacacacagaatttcttttaaaagattagtttgtcacaagactttcccaactcactcaaaccttcaagcatatcctatctaacttcaaacaatcctttaaacttttaggcaaaaaaaagtccacattcctatgacttcttataatattttaccaaaaacgcatttcagtttctttacacaccttgcatgtaaaactgtttcttcagttgtctcaataacatattacaatgttagcttttagcaatttttacttttggtgaaaaacctggttagtaagcgattttaattatgtaccaggtgtggcacctaagacaacagataagatttgactttttccagcatagctagggggcatggctaacatcacatgtccccaggtcttatctagaatctaatgctctaaagtaggtaaattgaacaattttcaaaagtcaaacaagcagtttatgaccttaaagcatttagaaagcttaatatctgacctgtaaaatttagaccaaatgtctttattttatcaataatctttaaaactgtttttactttccaaagattacttaagtcgtgtactaaaaggcattacactttttacttttctgacaaaatatttgatttaagctcttatttttaaactaattaaagtttttaaaaatatctcacacacacacacaacacatataaatacacatacagaagaagattcagtagttgtaagacttttcatttgccagtttctaagtttgtctttaaggcatgcagtttctagggcttaacttgcaggcacagctggaaggcaaaacagatatacaaaattaaggatcccatttttatgccagatcctggatcccaaaaagagggaatcagcccatctccataggagtcttatctctcagcggtgggtggggacttttttttaaccttctaggttgccaacagcatacttctctgatctaaacatgcaaaaagccacatattcccccaataactgccattagccttccccaaaagtatatttcctacctagttattacacaacaaagttctctcataatactaagcaatttctgaccccccaaaagtgaaaaacgttggataatgcaatgcaaaacagaatagaaccttagatttttaaaggaatctatccatttccaattcctggagtttcatgaggaaaacaagtttttcccagaacccagtctgtggtgcctcctctgtttttcccaaggagtctcatgctgttagagcttgaatatccgctttaaataagctaaattttaaccatagcgctctttttaaaaagtccttttaaatctcttattaccgaaccaggccaaatggccaatattcctgtcttctgaactttaccaaaggtaatctcccaggtgctcaaagaaaggaaaaattccagaagggaagccggaagttgttcatcatgggtggggaagagaatctacaaatggcaaaagtcacacagatatcaaactagaaaagactcattccctaatcctggaattgaagctgggccaccgttgtaaaatggtgaagcctttgatgctgagctacagcattgggcagtttccattgcccttcccagaaggagcttagagcagccaattttgaacttgcaaaggcttttaacttctcaaggtaatttttagggctaaccatgaattccaaagttcctgctctccggaaggtggagaccaagagaaagtactgccacatagttataaggtcaagctctcaaggaaataaaataagatgagagggaaactttatccagttttttgtttttgttttttttagggacctgcagcaaagtttgtaactgaccagtttgctgggctggcttgaacagcgggcttacaggagtcctaagcctgtgttctatcttaaggtacccttctccattatagaacaacacagaaagacaaatttataacacaaagtacagattttactacagcttaagactagcctcacaattcctttttctgattaatcaaaacttgatagagttttggctacttctgatctccttagccacccatttacacaccagttacgataatattagtctgttggtccaggtacagatgaataaaaattcatttaggactaattttcttaattaaactctcacagggcaattttatttctcttatattctcacttgatctctcgtcttctctgtcaccttcatgtgctacccatggtgttacttccctcccttcatcctcctcacagggcagactcttggatttttagagagaagatttgtatttatagcccaaggcagggatagctataagcttcaggtcaagcatttttatagctaccaaccccttgaataatttctgaatatgattctataaaacattcacaaagtaaagtctaagtctgacatttcaaacacaaaatatgtcttcaatgaaccctgggtgtaatgataacatagtcattcactgagttttcaattttttttccatttcatcacaataccagatgagatacacaaggggttgaaaaaaacaactgtgttctttctctgcggagactgcagttgacagtgatgcaaaaaacaattaacctttctgaaaagccctgtttatcctaaccttattgtttcctgttcttttcaaacttggagcactctgggccttgttgcctctagagctttcaagatggagggaagacctggagtaaatccagagaatatgcactaacctgaacagcttcctaagagggggctggctctttgtctgtaggaagcagttcatttctgagtcatttcagcaaagttctggtttggtgtacactgtatagaacaaacacataggggtttgtggaagtcgaggaagctctggacaagatcctctcctttcagatctcctgagattttggggtcagcctgacctcatggttactgggaggccccaaagcagcctttaagtatgtatgtagttattcctgggagccttcctagaggcaagcataccaagtgtaacttgcaggtaaattgtagttcatagatcttggggaaagctaagggacagtatcatgggatgatgcccaatcacaaaaatcaggtagattacccaagaagtcatcattcttaagcagctttagagagagaatccaggtaacaaaccaatgaaagaatgtgctcaagagttaggatgagagtcagggcctggtgagcttcttatgttgacaaaggggtagttttaaaacatccattttacaatatacaatacatacctaaaataattcacaaacaaccatgtacatcatgagatataaacactcattttgagagcaaaacattacccaatgcattgaagccgctgtgttctcttctgtaattgaatacctgtgtccaccagaggtaatcatgatcttgaatttcctaatttgcctatatttatactatgaatgtaggcatttctaaattatatatatatttgcaagttatatacttcacatatatatgtatatatgtatatgctatcatttttcatgaattcttccgtaacgtaattttttttttaagagacagggtctcactcttttgcccaggctatagggcagtggtgaaatctcaaagctcactacagtcctaggctcaagtgattacctcctgccttagccttccaagtacctgggactacaggtatctgccaccatgcccagctaatttttaaattttttgtagagacatgggtctcactatgttgcccaggctagtctgaaactcctggcctcaagagatcctcccaccctggcctcccaaaatgttgggattacagatgtgagccaccacacccagcctgtaacttaattttttttattcagcagtgtttgtgagatctatttaggttgatgcatgtagcagaggttcgtatttgtctcaacagcagggctttttatgctgtgggcctagttttggaaaggaaggaagaaagaaggagggagccacttaaaggccctgatctgttatgggcagtccagattgtgcacttagtgtcccaaagtggtgacccaattcacccatcagtcagctgcaagagtggcgacgtgatgcagctggcggaggaagctaattataatggagaaaactgaatttgcatagagaaccaggaatcaactaaatccaaataacatttcctggttaaaaaaacactaaataaagatttaataaatgcatgtttactgttttaaaaaatagttttttgagttagatacaacaaaatttcaaaaattaggcagttttacaagtgctatgggaaaaatagcctaattaaatttttctctcctcttttttttctccaccgtcttagtgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggtagtattctttttattttttcagtcctccttgactgctttctgtttgtttgaagcaatttagatcagaaatgggccaagtgcaaccacaatggggacagatgtcagttaggaacttcatgagttctcatcagtagcccaaatatcggaaaactttggcatttcaccatttagccagacatgaaaatggaatttagctaataaagtggtattgatgagaacacttaatttgctaataaagtcataatttttagttaagaggaaggactacctaagtttgagtaccagctctggcaagtattagtcgtgtgactttgagcaagctactcaacttccctatgccttggtttcctcatcggtaaaacaaagataataacagtatccaccttatagggttgttgtaaagattaaggaagtttatacatatgtagtgcctgtcacctaagtgttcaataaatgttagctattatttatttgtaatgccattgtcagatcagtcttactggggatttgcctccagcacagctgcgagaagaaagggacctggagagtaaaaatttcccatcataccccagaaaccacttgaatttttaaaaataagtttcttgtgaagaaagttgaacgatgtgggcacagttgaatttcatatccactgtaggcagagctcatatttagctggtttccccggcatgacttcacctaatatttcagccagcatcaattctgattggttgcgtcgcctgctctaattggtcacatcattgttctgatcatttgcaaaatccactgtgattggctgctgcctgtaccgtctttgttttaaaatatatttggtcattacaccttaccccagaaaaaaaggagcagaaatagtgttccttcctcagtcactgccaactatgcaatgtgtaggttttgtgtcttgtatggctccccaagctacaatcagaagcttatgtttattttacctgaggagaaaacttatcatgtgattatattcacatgttgaaaaaatctttaatgtgcccaaagccactaggatctttagaaatggaaataatttaagtattcttgattgatgtttatttcacagttaagagcccagaagcttcatttccacttttccaagatattcaactaatcttgaagaaacaaaagtttcgatgaaaattattgcactttttctatgcatagaattcaggtggcaacaaaatgtagttaataatttcaaagaaatcatgaataatatttttgacattagtagtcaagtcatgaaaagtaaactaatttgtgtaatgccctgccaaaaaaaattatgttgtttatagggggtgacatattaactaggaattgatgacattccaaggggaatttaaaatcatttctgtcctggctaacacggtgaaaccccatctctactaaaaatacaaaaaattagccgggcgtggtggcgggtgcctgtagtcccagctactcaggaggctgaggcgggagaatggcatgaacccgggaggcggagcttgcagtgagccgagattgcgccactgcactccagcctgggcggcagagccagactccgtctcaaaaaaaaaaaaaaaatcatttctggccgggcgtggtggctcacgcctgtaatcccagcactttgggaggcagaggtgggcggatcaggaggtggggagattgagaccatcctagccaacatgatgaaaccccgtctctactaaaaatacaaaaattagcagggcgtggtggtgcacgcctgtagtcccagctactcgggaggctgaggcaggagaatcacttgaaccccagaggtggaggttgcagtaagccaagatcacgccactgcactcaagcctggtgacagagtgagactctgtctcaaaaaaaattatttctataggaataaacaatttaataaccagatgcccagagacaatgaagtacaatgaataggactttgttctgaatatttgtttctgtcattatcaataacttgtattaataattgttggctgggcgcagtggctcacgtctgtaatcccagcactttgggaggctgaggagggtggaccacctgaggtcaggagtttgagaccagcctggccaacatggcgaaaccccgtctctactaaaaatacaaaaattagcgggtcacagtggtgtgcgcctgtaatcccagctactcgggaggctgaggcaggagaatcgcttgaacccaggaggcggagcttgcagtgagccaagatcgtgccattgcactccagcctgggtgacagagccagactccatctcaaaaaataataataataacaattattattattatactctttcttcctttttctcattccatttttcttccctagtcttctttccttattccctataagtaaattcggttaaattgggtgtaatatacaacagagtatcaagaataaagtcattggtttcctggctcttcaaacttttttgagaatagcataagaaaggctgtttataaatccaagagatacttttacagaaaagagattttctaaagctacgtcttgtctccttgttccatctgcattaactgcattagatgtgttgtctcattttgttctgagttcttgtaatatgactcaggcttcaccactcttaacagcttggtgtattcagaagtcattccaaagtgggtggcatgatgttgagggtgtatgctgttgaatcacacagccagagttcaaatcttactttcggcatgaaatatctgtatcattttagacaagatgtttccatggataaatctagtttccccatttgacaacagaaataatatcagtgacatcataagattgttctaaggattaaataagctaatattacaaacagcttagagcaatgccagcatacagtaagcactcaaaaattgttggttataatcattagccctatagttggtttgtggtgcccttgatttgctagttgcagtagacactatcagtgctctactcagatcccctggagtccctctcacctcctagttttcatgcactttattctaaggacttgaagtacaaaattaccttcgggtgactggagtttcccataggattaaagagacacaagtgccaggtaaacttgagtgttaactgggtagcccaaagccaatggttgacgggtacagaaatccattgcctcaaggcagaacagactctgcaatgcaacttaagctccagagcttcccgtgggatgatgctgaggctggacttcacctaaaaatcacacccttgcttagcccctctccctgccttctcctgcctcccttactcccttatagatttctcttgagagcactacataagtcgcttgcacacaaatctacatagcagaattcgcttctagaaaacccagtctgagacactatgaagtttgtattaccaaagctattactatttagtaaagttcgtttcaggggaaatataataagtctgcaaggtgagcattaaaataaagaattttggttcatttgatttacaagctatgatcttcccaacaatttttatcacagtcattgtggtttacatactggtaaagaaaaaagtccaagctaaagaaagaagcccaagattaagcatcttggtcagataatataactttctgttggcttttctccctttatctcctctgaatagccattttattatgaatttaagtacaacctaaatcagttcagggtaccttaactttagcgcagtgggtctgcatggcaattaaattctgcaaacatttttctgatagatagatagatagatagatagatagatagatagatagatagataaaaatatttattataaagaattggctcatatgattatggaggctgagaagttcagacctaggagagatgatggtataatttgaatctgagtccaaaggctgagaaccgggagagctgatgcaataagttccaatccatgtctggcagtcagtagcaagggaaaactgatgtcccagcctgaagacagggagagaaaattcattcttactcagctttttactctattcagaccttcagcgggttagacgaggtacatccatattggggagggcaacctactttactcagtctactaattcaaatattaatctcatacagaaacaccctcacagaaacatccagaaataatgtttaacaaaatatctgggctcccagtggtccagttaagttgatacaaataattaactgtctcaggaatttatataaagctggctatagcccccgttcccacacttttgtgaattgtatagctcatcctgactctgtacccccgcttctgttgaactctcctctctccttgcatctcaccacttatggctattccttactcttttctttgccaggccagagaacttagtcctttttccttgatatcctccaaaaccatcaatacaagaaatttagatgggtaacagattttattacaacagtaaactttggtgctagctattacaatagttttcatcatgctatagaggtacaaatggatattttggggggagtctaaaggaagaagtaattaattacaagtaagatagaaactgaagcaatggtttcacagaaaaggtgaacgtttgtgcttgcctttgaaatgtgaaaaggacttttcacattggcaaatataggtcaactatgttttggctgtttaccatgagccacaaagccaccttcagactgtactaatcagtttcagaaggaaatggaaaccaaaattttttttagactgaaaaagattacaaagaataaacttatctgaaaagttagtaaagtggagtttgggaggcagtggatttattgttcgtttgtgtgtttatttgtttgaatagcttgtcctttgagataaaaatgtagaagacggagaaagcgtaaaaattgtactgaatcaatattttaggcctgacacccaaatgtgcttcacagtccacatacccactaaagtgtggcattgattaaggtgggactggtctttggggactcgtaaaggtgctccatacccagaaggcacatggcaagcctgataattacctccaggcataaatcatcagctggggaataggcatctgtctactaccattgcattttaagttcattcaagaggctgaaatatatttgtatacattcttctccttcagactaagcaggaaggagtggtaggagatagcgagacacaggttttcactgttagagggtaagaatatttttaaggttctctatggagagcaagtcactcaaatttattgacggctttactgcaatgaagaaaaagcagaaatgttgcaaataaaattgagctatcaacaattattgcaaatggataaaaatactgacagtttcgaagcacaaaatggaaatcattgttgattattttgattttgtaccttagattgcttttcatttacttcaaaagaactcagactaacatgtacgtgggtcataatatctactccaaaaaaatctcattaacaaatttttactctacttgatctctcacacctaaaaacaaatactgttaaatatctactttgtggtattgacttgtacttaaaaatcctcaacttattagtgaatattcatttcagcagtatattgtgagctttattctcactaagggtacatcatttccatttgaccaccatacatgaaaacatatctgcacatgttttctttggcacctaatcttgggcttgcctcagtggtaaactctattggttgccttacaacataacatttctcctttctttctatccaaatcaaagttttattcagctctagcagtgaattttttaaacaaattttttctcaaaaaaaattttttttattttttaaaaaatgttttaggccaggcgtggtggctcacgcctgtaatcccagcactttgggagaccaaggcgggcagatcatgaggtcaggagatcgagaccatcctggctaacacggtaaaaccccatccctactaaaaatacaaaaaattacccgggcgtggtggcatgcgcctgtagtcccagctactgggaggctgaggcaggagaatcgcttgaacctgggaggtggaggttgcagtgagccgaggtcgcaccactgcactccaacctgggcgacagagcgagactccatctcaaaaaaaaaaaaaagttttaaatatttgtgggtacatagtaggtgtatatatttatgggatacatgagatgttttgatacaggcatgccatgtgaaacaaacacatcatggagaatggggtatccatctcctcaagtgtttatcccttgagttacaaataatccaaataaattctttactttaaaatatattattaagttattattgactatagtcaccacactgtgctatcaaatagtaggtcttattcatactttctatttttttaactcattaaccatcccccccccgacccgagccccacactaccctttccagcctctggcaaccatccttctactatctatgtccaggagttcaattgatttgatttttaaatcccacaaataagtgagaacatgcgaagtttgtctttctgtaccaggcttatttcacttaacatagtgatctccagaccatccatgttgttgcaaatgactggattacactcttttttatggctgaatagtacaccattgtgtatatgtaccacgttttgtttatccattcatctgttgatggctgcttccaaatcttggctattgtgaacagtgctgcaacaagcataggagtgcagatatctcttcaatatactggcttcctttttttgggtatatacctaggagtgggattgctggatcatatggtagatcaatttgtagtttcttgaggaactgccaaactgttctctatagtggttgtactaatttacattttcaccaacagtgtatgaaagttccttttcctctgcatcctcgccagcaaatgtattttggtttcttgtgtaaagctggctcagttgaaatgcgccactaaataagccagaacttaatatctccaagagaccacagaccccagcctagtaactcccattcaccttatggttttctcttaatgtgactgattttgtcatttcagtgctaggagaagagaaggaaggagaaacaggaggggagcgtgcattcaaattgcttatttggaatcctgcagataagttcaatatttggttcaaatggatttgaagtgatttcaagaattatacattcagcctggaagtcagggagtctaagcgccaagcaataatacccttttaatacactataaatgtttgatcatttgtttgtttttccaaatcttatcactctaccactaagagcaaaattagtttgaccttctcaaaagcctaaagactcattgtccccataaaacaccaggagaactgttggactggacttctagtttggtaaacactttggtttaatcctaatagaattgccacaaagcttcttaacggattaacagaaactcccagcatgaacatactggctccctaatggaactcaaatgcttaatgagtcacagaaaaatgaacaaaaatattcagatctgccttaaaccttggacgttttcctagcaaagaccttaccaatttcaatatataattacatttagggaaactaactttaattttgattctagagcatttttctccgaggaagcgttacttgtaaggtgcaccataggcacagggccacaaatacctgatattcagagacatgttaaacattggattgtccaaataaataaacttgccagatcatttttaatatttttttacattttattttattgacacatagtagatgtacatattttcagggtacatgttataatttcatacatttatataatttgtaaagatcaaatcagtgtagttgtgatatccatcaccttaagtatttatcttttccttatgctagaaacattctaattattctcttctagctatttcagaccattttcttgggggtttgaaataatagatcaccatagtcataagtaagattgttacctgagactatatctattatctgtatctacatatgtctctatatagagatctatattatttcaaattattaacgtgtttatattatattcatataagatatatattatttcaaatacctagactatatatagaaatatatatagagataggttttctctctacatatataagtggagagagtctatataaagagagactcagtataggctggggattggtttcagggcccgggtgtataccaaaagccacacatactcaaggctaaagttggccttgtggaacttgtgtatagggagagttggcccactgtaaatgtgggtttcatattccacaaatactgtgttttcaatcttcatttggttgcaaatgcagaactcaaggttatggagatccaactttgtttattttttaaaaatccacatatagatgaacctgggcagttcaaacccatgttgttcaaggatcctctgtatattttttactcttccccatattcccattttactaccctttcccttccttgtgtattgtctctagccagaattggtatagaggtcatgtctctaggcagcaggggttagttggcactcacatcccaagaaactaccattccctttcaatgcaaattgcagaaacagaacaataaagcccatgtaatccagaacctggctgaatgttggggctggaagggggagtaaagaagacccatcccctcaaaggtaagtcagctcataagggaatatctaatatcaactatatccttggagaaataggtattttattcctaagaaaatgatataagtgaaaacttcactaataaaaatgtcaccactaatattttagatttcaggcaagtgaccattttatatcaacagtaatcttataagaatgttcctatgttaatagaagttatggtttaaccaatttaaatttataataagattaggctaacatgcatttcataatttttataattgttcttttattgcagagtaattaagcataatgaaaatatttaatgcaaagaaattaataaaattcttacacagcaagcaattttttaaagtttttaatctcagtattgtgctaggatctataaagggcatcaatgtctgcaacttttaaaataccataaacctcaatccacttaaacatttaatatcttctgatacatattttcattatagaatcaatgggcttattacagaaaattacataaccatataatatgaacattaaagtctcacatagaattccactttccagaggtgaatagtctccatttgtgttgaatttccttcctgtcacttttatgtgtatatatatacacatatatatatgcaattttcatatagttggaaattgcatgaaatttacatatacatactgtataaaatatcataaacctcaatctgcttaaacatttaatattgtctggtacatattttcattaatagaatcaatgggcttattatagaaaattagataaccatataatatgaacattaaagtctcacatagaattccacttcccagaggtaaatagtctccatttgtgttgaatttccctcctgtaacttttatgtatgtatgtatgtatatatatatatatatatatatatatatacatatatatatacatattttcatatagctggaaattgcatgaaatttacatatacatactatatatgtaaattttattctttatttttgctttgcattatttcatgaacatttttcatgtcattaaaaattatttgtaaacatttttattggctggataagatttcataacataagatttttccatataacatgaatgtgcaacgtgtttcttaactatttattcttatttccatgaacattctcattcttaaatcctcttatattgtgattcatattttgaataatatttccttaattttaaaaaccggcaatctgagaaaattgattcaattaagaccatgcatcttgtgaatcagattgtttattgtttatcacaaatctcaccttcctttcgtagaatctgaaagtttgtaattaactgccagtgatggttttcagtgaagcatttaaggaaagaacaacacataaaggaaacatttatattcatattcaacaaatttcaaagaaatggtgacaacatttcttgtatcatgtactgatactgacaactagggaaactgctcgaaatgtgttttgcaataacctttatctgtgaaaatgtgaatccccataagtatcacctaaaaaggtaaaatgggaaaaagtaagtactgataactgcctttgctgaacatataaccccttccccaccacatttaaaataatttagtttgcacaaattcaatttagagtcattctagaaataaacttcagttatacatttataaaaactaaaatggaaaccctctagtatgtgtccatattcagcagcagaattggttttaaagaatttttcatgagcaacatgttctctctaaagtatcagtttttttgtatgaatgcccaattttcttccatcaagtcaattctatcattgcattgtgataccaaatattttaagaagcccagcattttatcttggttgttttttaaagaaatgcagctttcctacttcttgctgtactgattctatctccatctctgtttttttctgagtaatttatcatattgataacaagactttctgatgtttttaatactcgagcaaggtattctttgggtttcagattagcaaaacacattcttgtttcttaatgggccaggaaattgagacaatagttattttaagatagttccatgtgggagacttggtttgctaattacgtatgagataaatttctgctatgataagactatagtgaataaacagcaaggtatcaaattgcagtgattcctaactcctttagagttgtaacgagctgtttttgtcatattatttataagatccctgtcttaggttggattcccccagaggtagaccttgaactcatgatttgtgtgcaagtgatttattaaagagaaaccataaactactagtagggaaagcaacacaggaaaggagaagaatctaagcaagggtgagaagtcaggcaaaatttggcagaggtcaccatcatcatgactttacagagacagataatgtttgctgttttgtctccattgtcctttttaaaaagaattcagaatgaatgcttgagtcattgtccctttgcatatatgagcacatttaatgtttctggaaaatctgtaataagtcattgattctcttaggttataagggattggttaagttcttcctcgtatttctgtggttttaattattttccctaaaactgttacttttcagcattattgctccgttgttttcagtattttttggatttgggttttttgttttgttttgttttgttttttgtcaattgcctgtcagttgacatggttttgtgagattttccggtatattcctatgagccaagctttttaatatcaggaagtttcttctgcagatatgaagacttcacaatgccctctttccttgagactatttgtaaacatgaaattggcacaagtcacaagacttctttatctaaacaagtgttcttttactccttcttcttgttactttctcttaagcagctttttatccaggcataactttttcccagttctcagagagttgtgattctttttaatagcctttgatttgaaaactaatcaaaagttatacaaaatgtattaagatagagtcatgcttgttgaagaatgactctcttggggaatatttgtcatgagagactttgtgataagatccagtttgggcagatgccatatgttgaaagaagctgggcgggcggaagaaaccctccatgtttactgaggcttaactttgagtgtgctcagcatggctttgcacagctaggaaagaaacaacagtcatgaataaatacggagtcctttctgagcaaaaatattttaatatattgagagccagtgggaggatactggtgtgtgggaagagtgcagattttggaatgtaaaattcagggtctgaatcctgacctccttatttaatagccctgtgacccacaagttacctctcggagattccactttcctgtctataaaatgggaatcataatgtatttttcatgggttgttgtcaaagcaatggtatgacatgtgtattagttcgttttcatgctgctgataaagacatacccaagactgggcaatttacaaaagaaaaaggtttaatggactcacagttccacatggctggggaggcctcacaatcaaggcagaaggtgagaggcacgtctcacatggtggcagacaggagaagagaacttgtgcagggaaaattccctttataaaagcatcagatctcatgagacttattcactatcatgagaatagcatgggaaagacccacccaaatgattcaattatttcccaccaggtccctcccacaacacatgggaattatgggaactacaattcaagatgaaacttgggtggggacagagccaaaccatatcattctgcctcttgcccttcccaaatctcatgtcctcacatttcaaaaccaatcatgccttcccaacagtctcccaaagtcttaactcatttcagcattaactcaaaagtctgcagtccaaagtctcatctgagacaaggcaagtccctcccatctatgagcctgtaaaatcaaaagcaagttagttacttcctagatacaatggggtacaggcattaggtaaatacagccattccaaatgggagagattggccaaaatgaaggggttataagccccatgcaagtctgaaatccaggggggcagtcaaatcttaaagctccaaaatgatctcctttcactccatgtctcacatccaggtcacgcacgctgatgcaagaggtgggttcccatggtcttgggcagctccacccttgtagttttgcagggtacagcctccctcctggctgctttcacgggctgatgttgagtgtctgtggctttcctaggcacacagtgtaagctgtcagtagatctactgttctgcggtctggaggacagtggccctcttctcacagcttcactaggtggtgccccagtagggactctgtgtggggctccatccccacatttcccttccatactgccctagttgaggttctccatgagggccctgcccctccagcaaacttttgcctaggcatccaggcatttcagtacatcctctgaaatctatgcaaaggttcccaaaccccaattcttgacttctgtgcacttgcaggttcaataccacatagaagctgcaaaggcttggggcttgcaccctctgaagccgtggtctgagctctacattgccccctttcagccacagctggagcagctgagatgcagggcaccaagtccctaggctgcacacagcatggagaccctgggccctgcccatgaaacctttttttgttccaggcctgtgataagaggggttgccgcaaaggtctctgacatgccttggagacatttcctgcattgccttggtgattacatttggctcctcattacttatgcaaatttatgcagccggcatgaatttctcctcagaaaatgggattttcttttctatcgcatcgtcaggcttttatgctttgtttcccttttaaaactgaatgcttttaacagcacccaagtcacctcttgaatgctttgctgcttagaaatttcttcccccagatactgtaaatcatctctctcaagttcaaaattccacacatctctagggcaggggaaaaatgccaccagtctctttgctaaaacataacaagaggccaggcacggtggctcatgcctgtaatcccagcattttgggaggctgaggcttgcagatcacaaggtcaggagatcgagaccatcctggctaacatggtgaaaccccctctctactaaaaatacaaaaaattagccaggcgtggtggtgggcacctgtagtcccagctacttgggaggctgaggcaggagaatggcatgaacccgggaggtggagcttgcagtgagctgagatcacgccactgcactccagcctgggcgacagagtgcaactccatctcaaaaacaaaaaaaaaataacaagagtcacctttgctccagttcccaacaagttcctcatctccatccgaggccacctcagcttggatttcattgttcatatcattatcattttggtcaaggccattcaacaggtctctagggagttccaaactttcccacattttcctgtcttcttctgagccctccaaactcttccgacctctgcctgttccccagtttcaaagttgcttccacatttttgggtatcttttcagcagtgtcctattctactggcaccactttactttattagtctgttttcatgctgctgataaagacatacccgagactgggcaatttacaaaaaaaaaaaaaaaagaggtttagtggactcacagttcctcttggatggggaggcctcacagtcatggcggaaggtgaaaggcacatgtcacatggtagcagagaacagaagagaaattgtgcagggaaattcccctttataaaaccatcagatctcataagatctcactatcatgagaatggcacaggaaagacccaccaaatgattatctcccaccaggtctctcccacaacacctgggaattatgggagctacaattcaagatgagatttgggtggggatgcagccaaaccatatcaacatgtaaagtaaagtgcctgttattatgtggctaagtgttgtgaaatttaggttttaatgataggcactgcatgtggaagctacagcacaaatgaaagcataattttttttatattcagagtacagaaagaaggtctggtcagccttgaattttcctcaggcaaatatgaaataccacagtgttgatggcattgtctctgaatcttacaaaagatgggagtgcaaggagctgtgcaggcatcagaatcaggctgctgtgacattattctgcccgcatatattattttagtgatttttgtgtcattgttgacaatagactttgtcagtcactgtggccttgctctcttaatggaatatgaaacactagttctagagaagtacttagcttgcaggcattacatcagaggctgaagcaaaacctgacagcaacatctctgcaagtggaagaaagaataaaaactaatatttcctgagttcttattgtatttttttgggaaataggtttggctgcgggtgacagagacacattataatcatgacttaaaatgggaacatattcctgtctaacgtaaaagtctgggttgactggtggcttttgtggtattgttatgggggctgcattaaagcaggggtctggactccctatcttttgttgctccaccatgttgagagtttagctcttgatccaggatggttcattcctatgttctcatcccagcttcaggaaaaagagaagaggtcaagggaagaggattctccctcttccattaaaggcatgacctaaaggtatatcgtttctgattacactccattggccagcatttagtatcatgacaaaacctaactgcaagaaatactgagaaatctagtttttattctgagtggccatgagtatagctagatgttccactaataaagaagaaagggagaacagatattgggaaacacataccagaattgtctattccataattattatgtgtcaagctgtgctaaacacttacaaacattgtcttacttaatgctcataacaacactgtaatgctgtttttacagaagtattttgagacacaaagaggttaagtctccttaagtcttgagacagagagacgttaaataattgtcttaaggtctcagaggaaataagtggcatagccagaacttgaacccaggcactctgactttagaaccctgtgctctgggccactgtgtaatccttgcttgctcattatctcccttaggccttgatgtgctctactagatgagattgtttaaaagcatcaaggaattaaagatactttataaactgtttattcatggcttcctcttcaaggcagctaattgcttccattctaaaattcctatcttatttggtgtaaaatggtgttcagtacaatttggtccagacaagataacacaagaaaaataatgccacacaaatgtgacaagaattttaatgaaagcaattcctgatttgaaagaaatgtgtctatgtgatgataaagcaaaaagtctttttaatacatggaacatttttgatgatgggatggaaaaaaacattcaatatatcactagaatacagaaatgaaaagattgtatcattcaacaaccatcaagatagttaatcttttcagtctttacaatttcaactacatataggtcagcaatttatatgttaatataaatgtatctatagagcaacaaggaaaattaaagaatgtgaagctgttgtagatttggtggtcagagaaaaccttccctgggcaagcagcagtaaaactaaaattaaaaaaaaaataagcgggagccagccagattaagaattaagttgtatgtttatcagtcaatataggttaagtgatgctgcagtaacagctccaaactcttagtggcttaaaacaacaaagatttctcactcatgccacatgttcataacaggatgtctggggactctacttcatggcattttcagaccaggatccagacttgcagagcagacactatttggaacattgtcattctctatggaaagaaaagggtgtgtggtgaaccctgcccttgattttaaagcttttagctgggattacttaccacgtttcattggccagtgtgagtcacatgatgacatctaatgccaacagggcagaaaggtgcaatcccaacttgctttcagaagtaaggagaatgggaagtatttagtgaacagataaatgactactgttttgggtgatggaatgtggagggaaggcattcccagctgaagaaatagcatgttcaaaggccctgaagtgggaaagaacttggtatatttatgaaactttaagaagaattatgttgctgaatcctatctcctatctgtagacaggagatgaccagagggaagagggagcagattaggcagatctttacaggctatgggaaagaggtataaatttcattaaaaatataaaggaaaactactggttggttttaagcagaggaaccacatgatgtaagaaatattttaaaagagtattgactaatgatattgattattccatggagagtagattggaagggaattgaaagtagggacacctaataggcaccttttcaaaattctaagtgagattgcatggtggttccagtttaatgcagtcttatttgaggcaaatattccatctattttagacattttttaaattattaattattatccatttcaatctccttcccatatgcctcaaattcatacagcacttcaagccactgcagtgagccacagggaaggaataaaggttttcttttcctcttcttttacttctttttctcttttctcttcccctactaaggatctgtgcctgcttatgttgaaggaaaggaaagagaaaagttatgcttcattgcttgaaatatttggtgatgggacaaagaggtctcctttctgtcgtcattaccatttctccatatgaaactgataacagaaggctgtgatatcttctcactctgtttaatccacatgaatgttcaaagagctgatattctgcctccaggatgtttgtagggtaggagacgcacaatcccaagcagggttccttctgttctggctccaaggggaagtgaggctgagaggagaaatgatggataatgagaaagtgatgtactcattagaactgaataatggtttcaacagtgtttaaattcatgattttggatataatataatttctagagataacaacttccagggtttcttcatgagagtgaatggtgcacatggacaggaaggtcaaagaagatgaccaggtcaaagaactgaaagcccagggagttggatgtgttatgcccaggaatgatgtactctgtaagaaatgaagccaagtcaagggtatatccatttcctgtggctgctgtaacaaattaccacaaacttggtggggacttaaaagtgcttagtatggctgcctgttgcaacacatgagtcatggtgtgtcatttgtctccttaactaacataaagggtaatggtaattcttagtagatgttttgtttagactcatttttttcctcaataccagaatgcctagcacagtgtaggcgtactataagtgcttgttggatgaatgagtgagacatgaagtcaaagattttaaaaactttgctctacagtttgaaaattctctttttatgaatctatcatcaggctgagaaataaatgacctggttcctgattccatctgtactgcttattatttttaacatgagtcttacaatacctcacaagctagtttgaaagatcaaaagaaataataaatagctttaaatattcaactgctttattacctagcatgaaattggatcctgagcagtatatacaataaactaaggcctttgttcctgcctttgggaagatgctagtctagatgggcatgacaaagtttaacaccacaaatgtaaaaagatatggtataaaatgtgtgggatgattctcaatttttttttcctagaacatagacattctgtgttgaagaagagattggctcagtagcaccaagcaatgacatgtctgtgaagcatttaagtgagaaggaacctgtcttctggagcagtgttttacaaatttggcaatatattggaataaacagtgaagcttttaaaaatcccgttacctaggccacatccaaagctaattatgttagaatctgtggaagtgagatttgcgaatcagtatttttaaaatctttccaaagtgattccaatatatagccaaatttgagactgaatctccaaagctgtgcttctccaactcaaatcacctgaaaattttgttaaaatgtaggttctgatccaacagggtctaaggcagtgcctgagattctgcattcctaaaacgttcccaggtgatgctgatactgctggaacaaggaccacacttggaacagcaattttctaaaggataaatatatcacatgtcaggtagtaaaagaagggacatggaacctatgtaccaagcagcatgctgggaactttacatttatcatctcatttaatctttaaaacaatcatgaaggaatattattactctcattttagaaatgaagagactggggttgagtgggtaaatcattgcctgaggctggacagcttattcatgatggaacctggatttaaacataggcatgtctaacagcaaagcccataggctaatagaaattgttggaaactttcaaatgctaagcagaagcttttcgatgtgaaatggtaggcagtctacagccataccactctgaaagcacctgatctcatctgaaatggtaggcaatgtctttattacttttcttaagtgcatggagattgtgcctacaatgatgctgagtttgatttcacactcctgcctcaagtagtatatataggcaggtaaagaaccaggtactgtgtatgcctgtaacctggggccatgctctctagtgttatggtatcaaagatatcctagagaagttacagtagaatgagaataaatactaatagcaaaataatagtgctggaagagaatgtcaaaattcaaaagtaaaacacaaacattttatttttcagttactgatatcaaaggattgttgcctctggagggagaaattgtatttcctgaaaatatttggttctaactccttgattcaaatgtccttccaaatgaaaatatctcttgattaaagagatgggaattgaaactagcgacaccaaataggcaccttttcaaaattctaagtgagattgcatggtggtccccagtttaaagcagccttatttgaggcaaatattctatctattttagacattgttttagacattgtagatatctctgctcctgtttgtttttttaagtgattttttttcccctcttctttcaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgtgagtttcttgatttttcatggaaagtggagattgatgactgaagggattggagtggggaaggcaaaagagaaaaagagtattttaagtttaaggatagagagtgcaggtgaaattacagcccaatcacaggcttagcaatgccttggcagggctctggggtgtgtgtgtgtgtgtgtgtgtgtatgtgagagagagagagagagagagagagagagagagatacagaaagaatatttttttaaaaattgcaaagcattgtaaaattggaagcctcactgaaccatatctctttctttttaatcattattaatattattattttagggacagggtctcactctcaccctggctggagtgtagtggctgttatcatggctcactgaagcctcgacctcctgggctcaagtgatccactcatctcagcctccagaatagctgagactacaggcatgcaccactacacacagctaattgaatggcagggtcttgctgtgttgtccaggctggtcttgcactcctggactcaagggatcctccagccttggcctcccaaagtgctaggattacaggcatgagccactgcacccggccactctttctgtatttcaaaacttcccctgagcatccttgtctcagggcccctcttggcttcacgtggctcctcagagggcatagataatttccctgagacattcttagacatttgaggtgactggcaatatggttctcacatgttcagcctgctctgcacatcagctgacaagcaaagctggagtacttcccgaatttcctccaaaccgaatttcctccaaattctttctcattccttgagaaagaatgaagggagagaaccttcccatttgcctctctgtttagcctgtgggagtgcagtaagcacaaatttcactttgccaacttgggtgaaagccaagagtcattgttttctcagttcagttaaaccagtcttagtctgattcagtctctactgctcccctccttttgagaaatttcccctgaatccactggtatgttttctccctcccagtgtctgtctcctctgctctgggaggtgcctcataatctcatctcaaggcagctgagtgttcatctacctttcctgtgaatccaattcattggtttttgttttgttttttgcctagttaactcatcctgttacagtagtttaggggctgtcttgggaggaaaagtaaatagtgagatagtagaagtgatctttcattttcatcttctctaaatgaggactaccgttctgttgaagacgcctatattcagtgcttacatttttagccaatgttatgttccctgtactgtttcacaaaagtgatcctgaatagagcaattcaaactatgttttaatactggattgagataagtagggttatttttgtgaatacatagcaggtatatatatttatggggtacatgagatattttgatacaggcttgcaatatgtaataattacatcagggtaaatggagtatctattacctcaagaatttatcctttgtgttacaaacaatccacctatactcttttagttatttttaaatgtaaaattaaattattattgactatagtcacccagttatgctatcaagtactagatcttatttattctgtctaactatttttatacctgttagccatctccacttcccttgacccccactacccttcccagcctctggtaaccatccttccactctctatgtccatgagttaaattgttttaatttttagctcccacaaataagtaagaacatgtaaagtttgtctttctgtgcctagcttatttcacttaatataatggcctctattttcatccacgttgttgcaaatgagtggatctcattcctttttatagctgaatagtactccactgtgtatatgtaccacattttcttcatccatttatctgttgatgagcacttaggttgcttccaaatcttggctattgtgaatagtgctgcagtaaacatgggagtgcagatatctcttcaatatactgatttcttttcttttgggtatatacctaggagtgggattgttagatcatatggtagctccatttttagtagtttaaggaacctccaaaccgttctcctagttgtactaatttacattttcaccaacagtgtgtgagagttccttttcctccacattctcaccagcatttgttattgcctgtcttttggataaaagccattctaactggagtgagataatagctcattgtagttttgtcatgcatttatctgatgatcaatgttgttgaacaccttttcatatgcgtgtttgccatttgtatgtcttcttttgagaaatgtctgttcagttcatttgcccattttaatcagatgattagatttcttcctaatcagattattagattttttgtagagttgttcaagctccttatatattctgattattaatcccttgtcagatgggtactttgcaaatattttctcccattctgcaagttgtctcttcactttgttgactgtatcctttgctgtgcagaagctttttaacttgatatgatcctatttgttcatgtttgctttgattgcctgtgcttgtggggtatttctcaaaaagtgcttgcccagaccaatgtcctagagatttttctgcgaagttttcttatagtagtttcatagtttgaggtcttagatttaagtatttaatccactctgatttgatttttgtatgtggtgagagatatgggtctagtttcattctatgcatgtggatatccagttttcccagcaccacttgttgaagagactctcctttccccaatgtatgattctggcacctttgtggaaaatgagctcactgtagatgtatgtatatgtttcttcattttttattcggttccatcggtctttgaatctgtttttatactagtaccatgctgatttgtgtatgctatacagcataaaaacatagaaattatagttctgtggtataatttgaaatcaggtaacgtgattcctctagttttgtttttgctcaggacagctttggctattctgggtcttttgtggttccatgtaaattttaagattgttttttgcagttctgtgaaaaatgtaattggtatcttaacagagaatgcattgaatctgtatattgctttagataaacagttttaaagaaacgaatcttttaagttcttttattacttactttggatacgttattttgatttacttaagcaattattctcaattctttatctcacataaataaatttttcttagtcctttctgtcatcagcaaacttccttctccagatctgggaggatgaacagtgatgaaataaacaatatatggatttcaacataatcttttactgatttgaaggagctctttatatattctacgtacaagctatgttggttacctatattgcagatatcctctctcacctcctgacttggctttccattgtcttaatggtatcattttatgaacagaaatctctactttttagtagttccatttgttaattttttcctggattactagagggatttttttctgaatcctgttgaagaaaactttccctaacaccaaaatcatgaaaatattctcctatgtgatgttttataattgttattgtcttaccttttatctttaaacttataatccacctgaaacttattttgtgtgcatactgtgaattagaaactgatttttatattttaatgtgggaattatgcagtggctgatttgagtatcctagataactctattcaatgatgtttgttaattgcattgtccaagtcttccatatacttagtgatttttaatctgcatatccaatcagatatcgagaaaggtatgctaaactctctcaataataattgtggatttcttatttatccttttagttttgattatatttgctttatatatttagatttactacagagttaccctttccactgctctttattctttgctatatctctatgcttccatcagaataatttttcttcttcctaaagggtaccctttagtatttcctttagtgtggctttgctggtggtgaatactctcaatttttttcttagcatggctttatttcactcttaattttcaaatgtgtttgcactgcttattgaatcctaggttggatgttattaactttcagtaatttgaagatcctattggcttctgatttccagtgtttttattaggaaatcagctatcagtatattattgttcctttgaaggtaatatttttaaaacgtttttaatattttcccctttttgtcgtgttttcaacagttactataacaaacctatgtctgattttctttgtatttatctattttgatgttcctagaacatcttgaacctgtacattaatatcttttgtcatatttgaaaacttctcagggaatatctctttagatatttcttttcccccattatctgtctcctctatgccaggtagtcaagatatgcatcttagtaatattcagcatcttttagatatctttatgctcccttctgtatttgttatccatttacatctctaaactcagtttgtatattttgtctgacctatatttcagttcatgaatcctgcctttgtgtctaatttgctattaaacacatccatttaattcttaacttcagttactgtgtttttcaggtttagaattttcattttgcctctgttatgttttctaaccgtctgctgacctactcatttttttcttgtaatttcttgaagtaattatttggaattatgttaaaatgtataaattatagatctgttatctgagtcccctacgggactacttctattgtttattgtttcttgtggttttggtcatgtctttcttcccgtaaacctagtggttttttattgatggccaaaatatatgaagaaatggtaggacttaatgagactctgtataatatgcctctattgagaatgtacatttttcttctgaaagggaattaggataaggctcttgcatatttaagattaccttaatcaagtcaaggattgaactaatttcaaaattgggaccttggtccccatgagggctgatctgtttctggatcacataaactcatagggaatactccttcagagactcataacatgcctattagataagagaggcaattggttttatattttatggatagtgtaaacaagaacgctaagagttagatgtgtgttagtagagttgggatgagtttaaaagttttggggttttttgtttgtttgtttgtttgcttgttttttcacacagctcttttcccaccagattctgccaagatgagattttccattttagagcaatgaagaagaaaattgaattttaactaatgactgatttgctagtcctcaactatggagtctgaggatttatgggggaatttctcaataactatttctctaaatttataaaatactatttgatcgttagtatttatttttgtcatttatattccatgtttgttcaccctcttctttacacccaaggccctcactcacttagacaacagtaaccagggactgtgactcaaaaactcttcaatcaattataagtcatcttaagcttctgtaccgggagaagaattttatctttaacttctaaatatcactatctaaatatatctatctaaatatcattacaaggtaattactgaggtatacttttcaatacaagatccaaggagattgtgtattcacacattttgccatcaactaatctgctagttagtacggatgataactagaggcctaagtcactcataccgctctcctacattttatcagattaactttaggttattttaatgagaaattaacttttaatataagtcagtggaattcggagattgttttagaagctagcctacccaaattaatataaccctttcctgtggtttttcccttaatacttacatgctctatattttacttatttatcttattatttttctttctccactagaatgtaagggcaggagtttttatctgtactgttcactgatgtagttctagtgcctaaaataatgtctatagtaggtactcaatgaatacttgttaaatgaacagatagatgaatggataaacaaacaaatgaacaattgaatggatgaataaatggttggcctctacttaaagtatatcaggcttaagcaagtggaacaaatgtagaacaattgtggttttcttctgtcaggagcatgggattaaaaagaaatgagccatgccaaatgcatttgccctctgaacaaagtaaattcctaactgtcacgtaaagatgtaacataagttgttgtcagagggtataagaataaataataacaaatcaaaacttccgtgtcttccttgggacatgttaatgcattgatacagaacttctgaatcaattgcactaattttattggtgtaacaataatttaatagacccaaatatccacctatataattaatccattcattaacccatccatctatctttcccacacatttattgataacctgttaagtatactagggactaaggatacaaagttgaataaaaaatggtctatcttcaatggttacacagtataaggaggaagatgagtttattattttattcataaatttctgtcttgatgcgttaaaatgtcttaaggaagaaacagctctttcaatgtgtgattctaacccttctatgacaacaacttgtcttttagttatatccttctgtgacagctagaaatttacatgatgagtatttaatttgatatatcaaaattacttctcatttttaaagctgaaaatcagagtacattacttctccaacattgcaactgttagtctgtgtgatattagagacttaaactatatctcagtattggaagtatcttgtttgctattcatggagtggttttcaaaacggaagcataaataatattttattggcagcaaacactctttgtttattgtgagagaatattgcagccccactgagctgtctctatatttaatagaccataaaattgaaattcccaccctgacctctaagagatgagatgagtcagaaggtgactcactctctaatcagttggaagtaaatgacctttattgtcatttactttggattgggtaaaagtaaagagcttttattgctttagcactgaaacgattacagcaaggactgacagaggaaggttacctgttataatgggctgagcaggccctgacattttctccaatcccttctgattccaacaagttggctattgtaagcctagtttttaaactctataaaaaacatgataaaagggaccttgacacagccagttaattcatttttctatcttaataatacctacaaaattccacattgttatgttagctgaggcagttgcagtccaacacaaagacagtcataatgatcattttttctaattagtacccaattgaattcagaaggccccaaagataaaagcaacatgagttggaacaaaacatgaaatattttttctttttttcttttttttttgagatggagtcttgctctgtcacccaagccggagtgcagtggcgcaatctcgactcactacagcctctgcctcccaggttcaagtgattctcctgcctcagtttcccaagtggctgggactacaggcatgtgccaccacacccggctaattttgttgtatttttagtagagatggggtttcactgagttggccaggctggtctcaaattcctgacctcaagtgatccacccacctcagtcttccaaagtgctggtattataggtgtgagccactgtgtcccgccaaaacatgaaatacttctaatatggcattgatgggcagatcttatattcatgctatgttgcaacatattaccgtgctatatgtccttgtgagaatctttgtctttttaaattaggaagatcctgatgatatttttatttttgattgattggtaatgattactgcaatggataaaatataactgaaatagatgaaaaatactgagtgtttatcagtaaaatagatttcaaaaaagataatactgatggatggaacatacacagagtgcagaagacgatgtatacacctttgttataagaaagagaaatacagcccctgacatctggaaactgggctcacactgacaaacctagtcccttgatgttaagagctggtcttgcacttacaggtaggccatactgttatcctgttggacatcaagcagtctcagggtaccagaatcccacaagatcattctacaacaataataaagtaaacaaaacaagaacactttgtaatcttatctaagcatagatgaaaacaaggtgactgttgaaaccgcaaattaccgaacatccccatttcttgactaatgtgaataacctcctactttcttaccaattagagctttagcctagcattagtctgccatccttctaaataaaatttatcaagataccaatgttagaattgtccccattctctgacatcgcttaatccagagaaaatccctgctccatctaactctcccgaaaattactaacataaacccaaatcctatagtaaatcctttcaagtgccctcttactgagactctccatgattcctcatggtatgtggagttttttttttcattattatgggcaaaaatctcaacatgtttgtccataggtgggacgagcatctggtcatctttggcctgatgagtgagtattggtaattgccacataggtcatttcaaaatcacttctaatttagcaaattttcatagtgcagctacaagggaaagattcatattggagtagtcctacatttacccaaagatttcttgaatggcaagaagctatttttagtcccttgacatgctattttgcatcaactatcaattatatacaagtgcctccacgcttgtatagaatgaggtgttcactatgagtatggtaccttaatagctatataaactagaaagatttttaaatctaaaaatatagtacatatccaaggtactctataatacatatagtttaaacaataataaaaatagcccctgtgtattcattacccagtctaagaattagaacatcttgttttgtatttttcattcccttgctttactttatggttttactgcatttggatgtgtctctaagtaacatgttttctagttttgtatttttgaatattatggaaatggaaatcatactacctgtattcttttgtgatgtttttatctcaacaacatgtttgtgaaatacatccatgttcgtgtgaataacattacattcatctacactgttgttacattcccttaatgcatctattttctggtcaacagacatttagattgtttcagtttataattttaccaaaaaatgctgccatgacattcttatacatatggcctgacaaacatgtatgagtgtgtacactcaatggtgggattcttaaatctgtggatcatgacctattggtaggtagtaactagcattaaaaacaagtggtgggatttttaatctgtggatcatgacccattggtgggtagtaactaacattaaaaaaaagtggagtaaaaagtgtcagtatagatatacatatatatatgtgtgtgtgtgtgtgtgtgtatgtgtatacttatacatgtgtgtatttattttctgagttgtgacataaaatgtatttcttattgtgacctctgccaaaaatgcttgagaagactacggcagattgtgcatctgggaatgaaattgcacaccaaacggtatgagcattttcagcttgacaagataatgttaaattcttttttatagtggttgtaacaatcaaaaccccactagcattgtataagtgtttcctttacttcatgatcttaccaacacttggcttcatgaacattttttattttttccaaaccgatagatataaaggaatatctccctatagtttcaatttgcattttactgcttaagtatgaggttgagcagcttttcatatatttattagctttttgtggttctttttctgtgatatgagtatttatgtgtattgcacaattttattttaggtgctggtcttttccttattaatttggaggtactctttatgcttcccttcatctctaaatatgtttttgctttgaaggctattttttctgttattaatacaattacatcaaatttcttttggttaatagctgcatacatgtttttccaacatttgactttaaacctttctgtgtccatatgtttaaggtgagtctcttttatgtggcatatgtattattttaaaatatagtatatgttatatgtattttaatacttgttatacttatatgctacatacattacatatgtgctgtatatacatatacctgatatatatactatatgtaatttttaacatttaatctcataatattgtttcttaaattatagagtttagtctgtactcactgattactgcaatatttacatttatttctattatcattgtgattcctgaaatatttgcatttatttattttatctgtagattcattaaagtgtatttttctcatcccatgttatcctttctactggtattcgtattatatgcttttttcattttcagtggttaccctggaaattataacatttatatttaactttgcaaatcaatagctaaaagaaacttggtattcttgaactctaaatattattttcctggctgatacataatttttgtcctttgttttagacatttcttattgtataatccaacaatttatgtcatctcatttttctttataaatcaatgtttgtttagatttttatatattttatcaatttcattgttcaccatttctttttatacctcagacctattttacctctcctgaagtatagtctttaaaagttcctttagtgagaatctatttggtgataaattatctgttttcattatgttgaaaatttctttatttcatcctcattcgtgaacagtgatttctgtggatatgcaattctagattgatagtattttctcccagcactttgaagatgtgtcattggtttctggatttcatcattgctattaaaaatcaactgtcatgctaattgtggttcttttgtaggtttccttttgccttcctggctacttttaagatgttccctttgtctgtagtgctctatagtttcaccataatgtgtctaggggtttcttttcacttttcctgcttggaaaggaagaaaggaataaatgtacaccagcatcttcatatggccaaggtccttgtttgtcttcttcacctctgtattcttagccttagcccggggcatgacacatagtagaaatgcaataaatatttgctgtgtaggccgggcgtggtggctcacacctgtaatcccaacactttgggaggcagaggtgggcggatcacttgaggtcaggagtttgagatcagcctggccaacatggtgaaaacccatctctattaaaaatacaaaaattagccgggtgtgatggggcatgcctgtagtcccagctactcgggaggctgaggcgggagaatcgcttgaacctagaaggtggaggttgcaatgagctgagagcatgccactgcactccagcctgggtgacagagtgagattctgtctcaaaaaaaaatgctgtgtaattaataaatgtataaaaaaattgaattagtttccttatgaataatagaaaggaactaatatcttatctcagagtatctaataagcatatcttgttgcagatgtctccagcagttaatagaaaataaaggagcaaaatgaatcttttggtcattattcttttttaagataagattacctattttcccctgtaaaactatagataatttaatttgactttacattcatataagcttccaagtgaaggcttgaaaagtcccagaggtttagtgttaaagaaaaccaggacaaaacaaaccctgaactgtcagtaatcattattcacaaataagtatagcccactgtgattttaatcaggcccattcttcagagtatgacttacagtgcataaagtctatgtcaagtcttgtgtttttcaaatactagattgacatgacagagagggatataaattttatagtgggtgggatttttattttcttttgtcttttaccccttctgtattcttaccactccaccctcaacacacaaacatgcacacgcacacacacaccccacaatcacagccaatcatatgcaatgctatgtttgttattccttggactctacaggttttcacccttcctcaaagccctgttatagttgacaagtatgagttctcttcagacaatttttccaagtataaagcatgtgggatttcaatacaaatcctgtctctgacataatacctttataactttgggcaaattgtttaacctatgtgagctttagtttccttgtctgtaaattggtaatggtaatagatacttcattgcttatagtgagaattagagataccgtatataaagtgactagcctattacttggtgactgacatgcactcactaagtattagtttcctgttctaccaagccttctgtctgcctcctgacaagacgtgacacctgagagggtgacaaaggcataatctcaacaatctgttctggtattttctctgaaatgacaaatgactcaagtgcattatctgagttgaacaaatacaagacttatagttattattctccaagggtagcaagaggtaatgactaacaattctgggaagatcttatttgtgttaggtgttggcagctctaagcatgcatggtaaaagtgatatggaggcccatttcctggagaatgtagactggatgtgtccactttcttctgtcacacatgaaactgctgtcagtatgctatctactccatctcacatccaaagaacatatcaaaaaaaaaaaaaagatctaaggccttggcatgccactatttagcaatttttagtcactgaactatagtattcccccttgttcttatttctttttgtgtactctttgcctcctgcaaaagttaaaaactcttcttttttgtaataaaacaccagagagcaaatattttaggctttgagagctatgtggtctaccgctgcaaccacttagctttgtagttgtagcacaaaagcagccaaagacaacacataaacaattgagcatggatatctttcaataaaactttatttatatgatcaatgaataaaggactccctatttaataaatggtgctggaataactggctagccacatgcagaagaatgaaactagacccctatttttcactatatacaaaaattaactcaagattgattaaatatttaagtgtaagacctcaagctatacaaattctagaagaaaaccaaggaagtatcattttgaatatcagccttggcaaataatttattactaattcctcaaaagtaattacaataaaaacaaaaattgacaaatgagacctaattaatctaaaaaattttacacagcaaaagaaactaacagagcaaacagacaacccacagaatgggagaaactatttggaaactatgcatccaacaaatgtttaatatccataatctgtaataaagttaacaagcaaagaagcaaataatcccatttaaaagtgggcaaaggacatgaacagacccatctcaaaagaagatatacaaggagctaacaagcatatgaaaaaaatattcatcactaatcatcagagaaatgcaaatcagaagcacaatgaaataccatctcacaccagtcagatggttattattaaaaagtcaaaaaattacagatgctggtgagtcgtggagaaaaggaaatgcttatacattgttggtgggaatgtaaatttgttcagccactgtggaaaacagtttggagatttctcaaagaactaaaaacaaaactattataccattcaacccagcaatcccattactgggtatatacccaaaggagaaaaaagtcattgtacaaaagcacatatacttatatattcacagctacactattcacaaaagcaaagatattgacttaacctaggtgcccatcaacagtagattggatcaagaaattgtggtacatatacaacatggaatactatgcagtcataaaaataatgaaatcatatcttttgcagcaacattgatgcagctggaggccattatcctaagcgaattaatgcaggaatagaaaaccaaatactgcatgtcctaacttataagtaggagctaaacattgggtacatatggagataaagatggcaacaatagatactgtggactcctgggggtgggggcaagggttgaaaaactacctattggatactatgttcagtacctaggcaacgggatcgtttataccccaaccctcagcctcacacaatatacccacgtaacaaacctgtacatgtaccctattaatctaaaataaaagttgaaattattttttagaagaccctatttatagaccctgaaatttgaatttcatatacttttcacatgtcattaagtatttttattttgatttttttcaaccatttaaaaatgtaacaatcatttctagcttgcaggctgtacaaaatagatgatggggtgaatttgacccatgggccatagtgtgcctaccttttcccttttgtttctgaattttccttattcatcttcttacaacctatgcaatttcctgagttgaatattagaacaaatatatttctatgttaacttatcatagtagttttctattgccaccttaactattactacagcttagcagtttaaaacaatgcaaatgtattatttcacagttttggagctcaaacgagtttgactcgtttctctactccaggttctgtaaggctgaaatcaaggtgttggctagttgagttcttttttctataaagagattctgggaagaatccacttccaagttcattcttgtggacagaatccagttccttgtggctgtcagaatgaggtgctcatttccttgttgactgttcacggaaagccattcttagctcatagaggtctcactttccagtcattgcctgtggacctctacacctcagagctttctcagcacataaaatctttctcatatttgcaatctgactttccattctgcattgtctttactgacttcctcttcttcctttgtgtttaagggcttatgtgattgctttgggcccatgtggataatctaggataatctcactattttaaggtcagctaattagtaacctaattccatctgtaatgtctgatcacatcagcacctggattagtgtttgactgaatagccaagaaacaggagacatctttcgaatttagaataccacaattgtcacctggatttccaacactgtgatacataagtctatagatcacttgaaatgtatccagaaataacttaacccattcaagcttttggttttggtaggttatatcttagatttgaccgtattccataagcgtattttatatagttactgttatggagcttatccaatagtctgggcttctcaataggtaatataaccacttgggagtaaatctatggtagacaaactatggtcttacctttcaatgaatacttttctccaaggttaacattttcactttttgccagtagtggaatggtgtttcatatataatttacctttgcctcagattccgaagcagatttcaggataattgctgaacaagcagatttcaggataattggggaagaaggttgacatatttttcaagagtgacttttctatttgagatccagctattgattttcaagtccaataagttgctgaatcaaatggatataatattctggggcttgaaatgcctatttgactctcagttgcttttcctcagccaccatatcagacatgtcaccaattcttactgattctcattctcagtgggccaagtgtatgtgtctttccctttactcctcacctccatgataccctgatttgcatcttcatcattttctatcctctttattgtttaactttctaatttgcctgcctacctctggtttctctcttcttcatatatttagccagagattatgtgattcaatctgaactttagaaaaactgctagaatgacattccacctctttacctcagcattcaaatatttgaccccaaatcctaccttttaactccagttttcaatagaattctccacaaatcctttaccgtagttacatagtcctatttactattttcagaacatgcccatagaggttttgggacaatagtgctcacctaatcagctaaagccatttcttaatttttaattagaaatatatttagtctaccgaatgacttctacagctgttaaaatccttgtgatatgccagaaaaggacttttatagcagcataactactataggttgaattccaggtattctaattcattccacaaatatttcctgagtgccagttactgctcctggaaatggtgaacaacacagccaaggtccctgccctcatttcactgatgataataagaactatgagaatatgaaaagaagggtaatgtgttaaaattatgagagagtagtcattcatttgaaaaacattaattgagatcgtggtctgtgaaagactttcttgtaggtactatggaaaacaaaagatgaagcagacagaaatcagttctcagagcatttacaacccagtcgaaatgagagggtagaaataatactgaaggacgctataagtaatgggagaagtacagacaaagaagaggattataagcatttcaggagggaagatgggggtgatttcatgtagccattgcaggtagggtttaaaagatgggtgtgactattcaaggatccttctttcccatctttaacattgaacttattaccaaatccaggcaagcacttccaccacctatgatctgaatttattactcctcttttagtcttaccattgccctagcatgggtgccatcatctgtctcctggactattacaatggccaacctgtctctttatcctattctctcatcagtctaacccactgtacatgttatatcaaagaatcttttcatcacagagatctgatcataagtctgatcacagagtctgatcatgacctctttttcattccaaacctttacttgatccctattgcttgcattgaagatcacttatccactaatgcagtggttaagaacttgagccccaggtcagacttattgggatgggatcctggctctgctacttaccagctgtgtgatatgaggcacattattttattgctctaagtcccaatttcctcatctataacattaggataatagtgtttacataaggttgctatgtggataaaaatatatgaagtatgaaccgtaattagcaagtacctagcagatagtaaacattcaattaatactggctattattatcaccataaaatactccagagattgagataaactttataaataatttgctgttttcagtttattagggatttttgagagttaattatgtggctaaataattgaatttcaatgctcttcccttttcccttgagtaggcagctaaggattataactggtgagtggttttttgaagaaaaggcaaaacgtttcaagcaagtcaatgttctcggcactgatgttgtccgacagtccattttaagaagaagtccaggtaattaaagcaattatgtggtttcacaactgttttcatctccatttggctaactaaataacttctctatgttatgtagttaatcagcataaatgagtttcttgaatcccttagggcatttcacaacttggtagcatgaaatctagatacgtaattcatacaagacaagaagaagtcagtagaaaacaaaattcacaatgattttccatatatctcacccactaagattttcaaagaaaccatttgtctccatcatagacagttctctttctgaatgcatccaatattttactaaacacttaaagtaacataaaacagatgaattaaatgattcacattgtgaaagcaatccttgatttttcaacaatatttatttccgatttcctttcaatgttactttttaaatccagtggttctcaatcaaagattgataatatgtaccttgtctccctccctcaaaatgggagcatttggaaaggcaaggggggcatttctggttgtcacagtgactggtgagtcaatggcatttggtgggaaggagccagagatgctaaatggcttgaaatgcatagtcttactgaatgaatactggcaccaaatgaaaataacactttaccttgacagtgccttttggtgcattcaaattacaatttagttaattaaagatggagtaaaccttgtgattgggagcatgtttctcgtatatggtgtagtaaaagcggaagaaacatctttcagcctgtttctaggcttatctcatctttcatccagaggagacaagtgcccttgtatttaagtctggcacatatggcgagaaggcttggaactgattccagtggtacttctgggtgtggcactagcaaggaaaggcttttccacataggtcacacagatccgatactacagagagatggtgtggagtacagttagaattaggcaatcagccatggcctcttcttccactcaaaccccagtaccttccagaatgtaggcagttcctcaagtcacaatatatttgcacagatgcccaccctcccaggaagtgtggcttatatgcccagaaattaggacatcatttctacaacctcatgctagaactcagtctccagggatttggagatcttaggagaccatgttcccctgctctaaaaatatcaacagaaggctgatgcagtcatccctaggaaggttatctcagtaaacctcccacagatgagttcaggatctttgtcttcagttaactctagaacactcaacaaattagaactaactgtgtgacagaaaaacttgggatgggaatggcattgccaattattatagacttccttgccctgagctaatctgggaaagtgaaagcagaatataaatttgctctcatttctggccattttgtatgtaaatttctcttctgattgtttgttaatgaggagctgaagaagtacagagccaagagcaaacccgccaggatgcagaaaagtcagacacttcacctgttgctgggaagaaggccagccatgatgggcccaagagaaaggggtaagacatggtctttctgagggaatttttgatctttattccagacacctctgaaatgaagactccttaatttttcaagtttgatgtcacttcaatgacccagaggaggtcagagactcaaacaaagtaacactttcttatcattctcctcaggaaatgcagttttaataattttcaataagtaaataaaagtcctgtctgacctaagcacagaagagttttcctttcatttgacatatccagtcttgcactatatggttcccattacttataagtagaaagtttcatgccaggatcagtctataaagaggtgacaacaatttctgttgtacaatgtcaatactcctcccctccaacctgtgtgctgatatataattttatccaaaataaagatttattaattgagcttaaagcaccatattccctatttaaaattcaggcttccttaagaaaaaaagtcacatttggccaccacagtaacttagttcagtaaatgaatacagaatatggatgccaagtactgagaataggaatgggaggtacataagggagcaagaagtttctttcaagggagaaaagtggatcccaaaatataggctataaggaccaaaaggaaactgcatttttcagtttttgtttctcatgcagctattggccagtttttgtgactgaagtagtgagagttctaatgtgcaccaagtcattttatggtcctttctgtttttttattattattgagatggggtctcattatgttgcctgagctggccttgaactcctgggctcaagcaatcctcttgccttggcctcccaagtagctggtactacaagttgtatgccaccatgcctgcctaactttatggtccttttcagacagcattgcttcattctctcagtagaatgcaaagtgagagggcattagtgttagaagatttatctggctgtacaaaatgtctagggttcttttagaatcttgggctgtcagtaggaatacaatctaaatgtcatctaactcaagcactcatgacaaaccatgttttcattgatgagcagagatgagttggaaagatagcctagagtatcctgtatatcctatcctatgtattgatccttcctaccatcttgagttcatttatcactctttgggtcacccacaatgctttgtgcctttgcaccaccaatcatattgcactctgacaccccctcaacacacacacacacacacacacacacacatgcacacacttaattgtaagcttctttagtggtagaccagtggtttctttgcttctgtgttgcagtatctagcatggcacctgactcatcaaaaacaatcagtggcttgattgaataagtaactcagagcccacaaatgcctctaggagttgtcatttgcagaccccagctcaggcatcatagagtaggttacagaatagtggacttggagataggagacagtaactaactcaccatcacaatcaattatgcaaattctgaatcattgaaaccattgtagcactgggctgagccttagattctgattgttctcagtcatcaaggaatataacatctatttggggagaaaaggtacacacctgaaaagttactaagtataaaagaattgcaggaaaatttaagatggcaatgtgagcttcctaaaagcctttctaaaacagaggagggtgttcaccacaagagatatcctaaggttataaattactgagtacatataaataagcaggtggacaataagtgccagttgagtataggagtcatccagaaagacatcaaattgtacatgagatttgaggaggagataaatggggttcaggatcacaaaacggaggaagagtgactccaggcagaggagataccttaagtagaggacatgcatgaggtggttctcagagcagcataccttgacattatattaagtgctattctcaccaaagaaaaaatgtaattttccagtagattaaagcttcagatgctttgacaatgacactattccaggagtctttgaaacagagacaacatggcagattctattaagattgtgccagtacctttggaatccatgttttcctctagaaaactgtagaatgtaaatgaagtgtatctcccaatgccattacaaaaaggaatatagctttgattttcttattcaagtacatttggaaacacccatgttttgggcacatggtatcctggatcaggactttaagttcctaaaaggctgtttctgcttaaaccccaaataatttagtgaaattggaaggtaatcagattttatccaacatgaggcacaagaataaatgtcatggaagataataaagatgagtttagtcattcgttccacaagagttggttggattccagtataagccaggcatcattctaggctctggaaatctgtcaaggaacaagaaaggcagagtcactgctctcatggagctgcagtctaataagcagctacctcagtttgtccaagaggatcatcctggcttccctctctgagcaaagggagttcaaactctctattctcactattcctgcaaacaggcccaactcagggaatgcatcttctttctcaggtgacagtgctgagttctcagaataggcagtcttttgcttagtagtgacctaccagcaagtggtacggtcttgagagaacggcgtaaccttccccattatcacccttgatactgtattgcagaggcactgggaactctccagaacctctcagccctaaggctgctttattgaagaatcctttattattaaaagtactagaaattgtattcttgaaatgatatttttaaatgctttctttcttatctaattttaaatacatatatataatttcagatttcttcttagcaagttcagatcggcaaccagaggagaaatcataactcccaaaactgacactgggcggagctatagcttggacttagacggtcaacattttcggagtttaaaatcacctcctggttcagacaggtaagagtcatacagattgagcaatgatgtagcctgaggttaaggttgatatattcccattcatagggggattttaggtatctgtgaaatattaccacttggagaactcctaacacataatgtgaaaattcaggaagatattttttagttgatatggaaagcacgtaccctacttctagaattacagctattggaattgcctatgtcacctgcagggatgaaactttatattctggcacttggggctgcagttcaaatggaaatgtacagggcaagtaaatgtttttcattgacttcttgagctttttctatttaagctcctgaaaaaaagaaacctctgagtgtcaaatacattccttgcagcttttaaaaaattattaataattttaaatttgaatttcctcagagactttttcataaatttcacttcctttctagttccacctcttctaactggaggagattatcagtggagccaattgagaatgtcctatccacagatctatcacttgtcaagaaaaataatgagaaacacaaaggatagcccagagcatagtcattttatatcaggcgtgattttctgtatcctattggagcatagtcaagacttattttcatgattagtgtattatcaaagctagcaatgagaaaaaaatatccaccttcatatttcactggtttgtccaattgttaactccctttcgtttgcttgtgtctggggtaattttgcaagccagatagtacaagtagcagattttcttttctccttaggttaggaagaatgcaagcagaattgcattcttccctgtaatccattttagaatgcagaccaaaaaatttccttagaggggacactattttgactattgggttattttttcatggtgactctccatagctgtttcttttgtccctataacagtcctgcatgcaagcgttactttatgtaaaaccatacagaaaaaaaaaattacaaggaagcgtaaagtcatttatcacccattatcaaaatattaatactgtattcagtatttcccaaactttcaagaatgctgatatattcccttttatgattacaaactgttaagctatggttgcctttatccttgaaatagtttcatttgtcttccattgaggtagcttcatgctgtgtcccacaaaactttctataaacatctcattttggctgggcacagtggctcacatctataatcccaatgctttagaaggctaaggcaggaagattgcttgagcccaggaatttgaggttacagtgagctatgatcatgccactgcactccagcatgggtgactgagcaagaccttgtctcaaaaaaaaatgaataaataaatctcatttttgtttttcatagttggactcctgactctgagatagtagtggtcaaaattatttagagacagtaagcaactaatttggtgttctttttgctcagcctcctgggactccatggatgagccaccttggctaacacttaaggctagcatttaagaaaggcaatatatacaaaaagaggaaagacaatgttccttgttttttgtttttgttttttttttttgagatggagtctcgctctgtctcccgggctggagtgcagtggtgcaatctcggctcactgcaacctcagcctcctgggttcacaccattctcctgcctcagcctcccgagtagctggaactacaggtgcccaccaccacgcccagctaattttttgtatttttagtagagacggagtttcaccgtgttagccaggacagtcttgatctcctgacctcatgatccacccgcctcggcctcccaaagtgctgggattacaggcgtgagccaccgcacccggccaatgttccttgttaaagaaaaaaaaaaggctgccagcctaacaaaattagattgtgctattttaagttatatgtcttacagttactcaacaagaataatagggagcatggtctccagtatcagtgcttataccgtaatggactctatctgcctcagtttactctttgtgtattatctactactaggcataaataaccaaaactataaagccatatggacatgcatcaccaagtactggtatattgacccaggagcttcttgttctttttgtaagctgaaagaaagtccctaagtagactttatcttaaattgtaaatacctgaaatggcttacacatagtcagaagtagccaggagtgctttggcttaagcatgttaagaacaatattttgccactaagaaagtgagtaaagatgctcaggagatcaatagagcaaaatgtcctttcccttgaacgtgcatttatcacagtgatgactcattaatggactgccacagtgagatgagttccattatttcaaaatgagtccttagaaaattgaggcaggaggtagcccatcttttcttaacttccatcatctgaagagactgtaagatcccagtctctttggtctattgcctgacccagcttactaatatttcccctttttcccttacaatgcatattttttcatggatcattggtattttcatggagcagctgggcttcggcattcctttttaaggctcacatcatataagagtgtaaatgatgttttatcagatgtgcagttggctttcttttcagtagtttcaaagcaagggaaagtatgaatagattaaagaagccctagcagcctctcagaagagcttgtcaaatggatgttcaccggttgctagggacttgacacatgagacaaagaatatttttaggaaaataaatgtaagctgtagttaataaacaatattattcaaggtagtgatttctaatccctacaaagttgtgatgagctgtcactgtggtatgatttacaagatctctaacttaagtcatgctctcccagaaacagacccctagacaaggatttataagcaagtgatttattattaatcaagtgattccaagagaaaccaggaagggagtaggagagacagaatagagaagaggaagaagctaaacaatggtgctagctccagtgtggtctgaggactcagcctgatcctgtaggagactctagagcataaactatatccctgagctttttccacattgaggagctggaccattgcactcctataccagtcagtcattgaccatggcctcccttgaatagagtctctagacttagcaagtgaagatacaggatgcccaggtatgtatagttgagactaacaactgttttttagtataagtatgtttcatgcaatatttgggacatccttatacttaaaattaatttttttatctgaaattcaagtttaactgcgagttctgtattttatctgacaactcttctataggggtgagggggagacaaactccagggcatttctaggcctccagctccagggctaaagggaaggtctctgaaggtggcaggtgacatccattagcagaaaagaactcaggatctagggaggagcatgcacagctggtaaaaggaatctgagggagatgccaacaatgttatctttaaaaacagagtaaaactagaactttgaacctaaaatgcattttgttcagtaaaaatggaggaagaatgatgctgtttctcagtagcgtttctatcatgtcattggagaatatggcaatatctacatggaatgtgaacagacggtgggaccttgtttggtctcgtaaccaactaggttctcatctttctgccctcccactcctccactccacgcacaccagtttcatccagttattcctaattgctctccagtggatctgggactgatggtcacagtctctgtgaagcttcacaagctgctttgctttggctgtgatccaccaaaagcagagaccacaccattcaaaccagcccttagctagttcttgtcctcatttcaagcactgcccctctctttttctctctctgtccaggaaatatggcactttggatattatcatgaatttaaagaatcatccattcctcatatctattattttagtaaagtgagtttattaaacccattctatcactaaatgatgccttctttttcatcagaaataaaattattctcctgtcctgaatgtaattttcattgacatctttgcaattaaggtgccaattaggtggcagcctcttactagaaatttgaatatagcaaggtgggagtgtttaactctgagtcaggaccacatccacaaagtcaacaatggtctgttttgcgtattagataaaacattacatagctagttgctaatgctattagcaaactccattccttaccaggcttaaaaaaatgttcaaatgtatagcatatctctgaaagtatgtacatttattctataatgatcgttcggtgactcaacaggataaaggctgtgagcattgtcctccaaaggaaaattactttcacctctttcctgtgcctttccctcctttgtcactgctaattcctttttttccattttaatctcctttgggtaagctcagccctccttaggaggagcgaggggtgggcaatcaaagccacaagctgtagcaaatgctaacagcctaaagcaattcgcaaaaccatggtggcctgagaaaagtgaattttaattccagggagcaactgacacatgataaaacaggagaggaaacatgaattcaccagagtattttgttatgctgtgaccttatcagtgggagatacacagtctgaagttgcaaaaaaaaaagaactttagctagaaacttctatttagaactcaaagccatccttttctaaactcatcctttgcccaccatatgcacaaatatgcacttgatttgggctcctttggaagacaatcctgaaataaggattcaagagtaagtaatatgttcaggatgtggtctaaggaaacagagataggagagtggggaaatgagccagggaagggaaggcaggcaaaaaggatatgtcattaagccagttgttattgtgggcaactagagctcaatctcactggccaattctagaaaaccgtgctgaatgtacctcagagttatccagttaagagatagggaatctggggtatttttacagcagctctttgttcaaaatttattgagggctgcttctagggcactaactctctggcacttccgacttgccctgttcacaggggctccatgctcccatgagtcaaaaaactcctcaggcagggagttctgggtattcccagtaaccaagattctgtgggtagaggtaagtgctgaaggcaaatgggcagggacactgagagtctgctacaacctccctcccaaactgctctcagacctccttcaaagacgcagtttgtcagaccactgttcagcccctgatttctgtttactttatattatgtgtgactttcctcattataatgtcaataatgtgagaaggtatggaggctcagtaattcagccacacccatgcttcattcctgtgatcaaatgattgtaagcctgaagcctcctccttgctgttttgtctgtttctccaattgtttcccatggattcactgtcttggcatgctctatttctatgaactaaatctaacaccttcccctcctccaatttaataaattgctcttttactcactgctacctaaatatgtattatgtgacatgttaccactctcagggtagctaagatacaatagatagcctttcttcttctacagatcattgaagagcagagatatgtgacttggtcatctatgcattctattcatacaaatgaattcaacacacagctctgttaacattattgacctagtactatatatgccagatggtaaatgtggaagttcttagacagtaatactgttccacccttttatgagcttccaatttagcaggaaggctgggataactaaacaaataatttaaatacaatatagtaatacgattttaaaaagatgttctgcgtgctatgggaaaaccaaagataggcatttatcctttcaaaggattcaggtaagcttcattgaggtgatccctaagcagcttttaagaaatgaggaggacttggccaggtaaagaaagataggaagagcattctacacagaggaaataaaaagtacaaaggaaaatagacataaagtagactgtgtgctgaaaagaaactgttcagagtttctagagtataaaaattgaagtatggtgtacaagagatgaggagatggagaggtaagttggaccaggatgtagatggctttggatgccttaatacctatcttcttatatgcaatataacatcctactcagaacaagaggttggcaattctgaactactaagtatggagtaagtatttgttccatttagttgctgaaagttaagttctgttaaacactccccttttttgtgtgtctatgggggaaggtagttggctttcttcttgcccccgacttctaattgacccaaggcttttcatggctgctggcctctctcctcaaaacggcttctggtcattatttagaaataagacatttgatcagaattttaatgggatgctaaaaaacaaaaatattatcacgttgagagtaccacctgttcttaagatctacttcttcatacccagctggagtcccttcctcatggtaactgtctcctccattttagagggagtcttcttaaagggaacaaatccattaaggaaacactaaacattttaaaaccctcaaacaaagcagcttttgttttattaagtcaaattataaagctatttctatagttaacattaggattcatttggcacaatttcattgagtgcccactaccttatactactcttgtcctctttccaaaaaggaaaaggaagatatgtgcgagtaagccatagaaggccagtggcttcaggggacattgcagctacagaagctgcttgaggaatttccatgtctttctcatctctctgcttccctaattctgctttgaagtgatcctatgatggctcacttgggcctaagtttaacacacaaacacccaatacctgaaatttacttcttttgggtgtattagcttctccaaagagtttagtttttaaatagactcatgtgtgtgtgtgtgtgtgtgtgtgtgtgtgtgtgtttgtgcgcataggcactgtggtgttaatatatatatatatataggttttcatccatagttcctgcctcccaacttccatagtccttgttatactgttgggtcactttaggcctcagaaaacataaactctctctctgaccttctgctgtccttctttcacccgccaaagcaggactctaacctgattatggttcaaaagaccctcattccggaaaccctgcctcataacctagaggaaggaatgctacacagagaaaccaagaaaagtctgaacagacaagccttgctaggtttagatcatgcactttctgtccaatcacatttttacatggttgtcaatcatgcctatgtaatgaagcctccataaaaatccaagaggacagagttcagagaacttctggatagccacacatgtggaggtgccaggagggtggtacacacagggagggcatggaaactctgcagtcctatccccatacctcaccctacgcatctctttaactgtatcttttgtaatagcctttataataaactggttgatgtgtttccctgagttctgtgagccactccagctaattaaacacaaagagggggtcatgggaaccccaaattgaagacagttggtcagaagttctaaaagcccggacttgtgactggtgtctgggggaggacagtcttggggactgagtcctcaccctgtgggatctgacactctctttgaatagatagtgtcagaatttaattagaggacacccatctggtgtctgctgcttggtgtgtggggaaaaaccccacacctttgttcaccagagacttccgtgatgatcgatgattgttgtagtactgtgagagcagaggaaaaacatacttagagtttttccccaaactggcatacacacagagatcaaaaaccttttctgtaaaggtacagataatatttttgactttgtggtccatatgatctctgtctcaactactcaactttgctctcagaacatggaagcagtatagacagtacatgaatgaatgggctgcctgaattccagtcaaattttatttatgggcactgaaatttgaatttcatataatgttcatgtgtcacaaaatattattcttcttttgatttttttcaaccatttaaaaatgtaaaaactactctaagcacacgggtatatagaaacatttggtgggcccaaatatgtccacaagccatagtttgctgacttctagtgcaacacattcactcactaagacaaagtgtccttcagtgtatcacagtctgaaccacaagaacagcttagctcttttcatgtcagtactgttgaattaaaaaaaaaaatagtggtagaagcagagggagcaatgcaggtggagagatgtctgagatcaatgaacttttatccacagcttagcacagtggttttcagccttggcttcatattggaatcacctggggagttttaaaacatcctggcacctagatgccacacccagagagtcccatgtgactagcctcagtatagtctggacatgggagttttaatggctccccaggagtttctaatgtgcatctgaggatgagggccactcatctcacataagactattaataaagacacagcacttggggatcaccaaagactagaagattgagctacattcatttttagttatctctttcccatttagcaggcttatctcactttctaactgcaaccttccttggccatctttcctgcatattcattgtagatccaaaataactataagaagttaggaaagctcataaacctcagagagaatattttgcattgtctctgtgttgtactgcacattagtctcattgtcccagtgagttttaggatctctcaggttcgtgctgccttaggagagcacacatttaaccatatgggaacaggctcaacactatcagccactctgggaaggttggatcctgggaaattatttcctggctacaactcctaggagacctttatgtaaagcagaaaggcaattacattgtaatctctaccccctatccttggatcctctgtctagaaatggatgtatctgggaagctgttatcaagattttggagcaacatggtgctgtgctgaacccctattaacctcaatagggaaactgccaggttcaagagactcagagccagcaaacgagacatacaattttattagcatcttacacacaggggacagagtccagcagtggtgggctgggcaggaaaaccataaccgcttgcaaataacaatgcagtttatatagcattttcacttaaaaccttccccctaaacgacctccacctggaaaccttcatttaacccaaaactcagggcctcaatccccggtatggcccatgttccatgagaagggccaggggctcagatgtttttcataggtaagaaacaaacctcagggctggccactcctggattccctagcttggaacaaacattcagatgcatctgccacacagggtcattgtaagagtatactgaaatgattgctgtcagatgtgtttcccctacccatggaattagagataacaaaacagaaggcttttaaagtatatttcataaggtaaagtaaattaaactttttcctaatctggaaaatgtgtctttcagcaacccagaatatccaaactcccagacagtgacatatccccacatttgggccttttacagtgagataaatgtatctctttcttgccggtttttacttaaccacattttagcttgaaggtttgttggcactgatttatcatacttcttatttaaatctgagtaacattatagctggattaaaaaatagctttttcttagttgacctttacacttcacaactttaattttgacttgacatagcttttatcattttccaatttaagtggcaaagattcgtgtattttatgtcatattttacataccttctaaatgagttggcacacaaatatttatgataatatgccttattagactaaaccttttttgagtttaatcaactggaaaaaattttttgagaagctcacagtaaatgtcagggacaaatgtgaaattctatgtcatttttgagataatgctgctggcaatgataatttgcagtagctgacttacaatcacaagaattttttccttattacaggataacttcttgaatgtcatcaccacaattaatcaacttctgccagagcttctacataagtagcacttttggtttcagcaaggctaatccatgatggggcgtttctcaaaaccacctggctctgggaggaccttccgcacacacacaagcagaaacacccacatgagtccctttggttcataacttcttgggtcatttctgcaagattgacccctgccctttctttttaaaggatattttacctgaaacagtagggagacatatttctgtgttaacattgttctaaagaacctatggtcacagtacagcatcaatgggaaagtctctatgcctctcctaagtagaacctctgagatgagcagaatacttggaagggtacaaatatggctaactgttgtcaaatgtagaaatgtcatgcttcaggtagaagggttcaggaaaatcaccaaagaaattagaattccaaagtgtatcaatttacttaatcacaaaattttactctcttgtcagaatcaacaggcacagtcttagagatcttctcagctgagttcatagcactgtaatttacttagactgctatttctacaaagaggaagccagagatcctttctgcagagactgtttagtaaaaaagaaaagccaccctttagtaaccactctttagtaacatagaaaattttcataattctcttaatcaagtcccaagaaactaattcctagctctttgctcctttgattaacttctgtttgatagttcattctataaatgcaaaacctgcctggctggaatgatttgttcttagtgaaatgatgagtaagcagtatgagaaactagaatggtcacaggctttgggtagactgacaatactgtttttatgctgattttatcacatgctaactctatgatagcatagtggtatgtcggtgtgtgtatgcatgtgtgtttgtgtacatgcatacatgtatggaataattaacctctccaatactcaatttcttcatttaaaaatattaaataatattctaaaacatattttacaaggatattgggggatggaaaatggctaacacctagaagatactaagtaaatgccactgctattcatgattattgaaggtggtggtagctggtaatgtggtccaaaagaaatttggttttggtgacttctctggtgcacagctttgaaaaaacttaggagttgtggttgacagttctatccaatggtcattgcctattcttctgcctgatttatcttctagtaatgatatgtgcacatttaaacattcttttaaaaaatattcctttattctatttaacctttcctcttattggctcaactgtaagtcctcatcactattaaccactgctggtatgctttaccaataagatgtgtactattatatgtgcatttgtaactcattaagacagtaactgagagagtaaaactcataagggcttctattttaccacttagcatattttgtgcccactgagggaaaagaataaaatgggaacaaacacttctcttaaactccgacttgtcaaaatttatgttgacttatgaagctcatttaataagaaaattgtgaacacctcaagggcaggaaccactttttcatttattgttattggattgaattgaatagttttagcacacatgaaagtgattcaagcacatttaccaaatgtcattatttttgtaccacatttattaaatgtgcaccatgaattagacactaaaacaacacagagaaatgaaatataacttctaatctttgattaaatatgtactgagtggcttctttgtactaaggcactacaaagctgctggagatacatgacaattatggcatggactctgttcccaaggagttcatagtttaatgaaacacccaagctcacatatgtggatccattagggagccaaacaagacattttgcagtcaaatactaaatacagtagtctggcaaagaccgtaagtcaataggaattgagtggaacagaggttgacaaggcttatgcttgacaggaaaggcctaatggggaaggctggacttcatttgcccttgaagactgagaaagatgtgtatagacagagagtggttaagagggcataacaagtggagacaaggtaagcaaaggcctcaggaggtggaagtcaagatggtgagctgagaaaatggtaaggaacccagactggctgagagaatgctggtaagcagaaggaaacaaaatcagaaagatggggtgaagtttaattactgtggggcaaatggggacaaacctagtgatcccctcagggcctttgaggaggaaggtaacatgatagtttctaagcagttccagtgtgactcttgtgaactcagtgcggttcatatgttcttatcagtttcctcatcagctttactctgcctgtgtatttggttgctgctctgcttccatgttaaagtcagaatatgctttctcatttaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagtaagtacacaaacctgatgaacaccgtattagttcattctcacactgctataaagaactgccagagattgggtaatttataaacaaaagagatttaattgactcacagttctgcatggctgcagagacctcaggaaacttacaatcatggcagaaggagtctgtcaaacacttataaaaccatcaaatctcgtgagaactcaccatcatgagaacagcacaggggaagcctcccccatgactcactaatcatccgccaccaggtccctccctcaacacgtggagattgtggggattacagtttgagatgagatttgggtagggacatagagccaaaccatatcagacacccagtctctgaaattcaacctcaccactgcagcatggctaggtttcaactctgtttgtatcagagcatgttctttatgctgctgaaaggtagaagcttcatcaggactgaacctcctgcatcttagctcctggcaggaaacccaaaatgaaaaagggaagagaaagaccaggttcaaaggtagcacttgtatgatggagttttaaattgctatatggcttaaataaatataaaacattttagaaggctctgattttgatcctctctgttacttcttagagaaaatattcataggttgagtgcacaaatttttccaaactgatttaaatctggaaaagtagaacttttatctagtttttaaagtagaaatttttattttcttttctatacatctgttaacataggggtcaacacataatgaaggcttaaattgcattttatatttatatgtgatcaattatattttctactggttttctcttttaaaagagaatatgaaaaaagtatttggggaaaaatattctcttttattaaatattctgttggaagttatatttggaatgaattagcatttgtgagatttttttatttagcaggaagctccatccacattgctggcatctatatttgataaatctttatatgagcagtgagttcatacaatacaaacaattatttgactcaaccaacatttaatgagaacctactatatgacaggctctagtcaagcaaagacttgaaggaagtgaaagaattagcaatgtagttttctggggcaaggtgttccaccacgcagagacagcactgatattcagcaggtacatgcagggaaggctgctctacttccttgtagctggcctccatcttgattggtcagtgcccttgctcagccagtttctaaaatatttttaatgcctctagaagaacagccagtgtggagcccctgaggtgggagcacaccgggtatgttcaaggaagaggaaggaggccaatgcagctgtggtgaatgaatgaggcaaagtgaactaggaaatgaatccaaagaggtcatagggctggatagagccttgaagagtgctgtgtgcagtcagcattcactctgattaagatgggggaaactggaggttttagagcagaagagtaacacaatctgccttatctttaagcaggatttgggggctgtgctgagaagcagctgtaggagaacaagagtgaaagccagaaaagcaatcagtaagccattgtcataccccatgtgagagattgggttttgaaacaaagagatagtggaggtggcgagtagtcaaattccgttaaagcattcagacagactgaaaaacagtaatagatttatttaaacatctatagtctaaattgtagttgtgaagataaaaggcatatttaaaacttcataaatatttatgctaaggtcagcaagccatttctgttcaatagctagaaaggtgcatggatagttgacgaatacactcacctcttggaatctaaaaaggaatgatattcaaaccacttagtgaccagtctggcagggatgttgagaaatcacaacagacactggcacaaggctggggcagtatgcgggggcccttctatgtcatgcactaaacctgaattatggggaaacctgggcttatagatgagagggagcacagggaagtgggaggtggactgggagtagtgctgtttattaactgacacagaagtatttttaaaaatttaacatctagtacagttgtcccagtgggtagcagctgacaatcagtccaatgaccaataagttaatcaagtttattctcacaacaaggtttatctttctacgtacaatttgagattattaggggggaaatcacccttttcatgtgctaataccctcaaaactaacagcccctacttgtgtatttctttgttaaacagcacctagatctctgcaacagaaattccctgcaatttagtagagtatatatacatatacataggcagtgcctatgctgatctcattcttgcaatctagctggtctaagctggtcttttctaagagaaaaaaagaaacaaagagaagtactttctattgaataaaaataagacagcacagtagtttatgaagtacatttgctctttcattaaaagggaagtatatagcattagatggcaagtatatagcattagatgatgagcaaggtaacaactcagtttctcccatttcttagcatctctttgtttcaatgttcttttctgctctagcatgaaagaaaatatattagtcagggatctccacagggatagaactgataacatatatataagggagtttattagggagaatttgctcacacgattataagacaacatcccacgataggctgtctgcaagctgcggaaagagagaagacagtaggatggctcaatccaagtctgaatgcctcaaaaccagggaggccgacaatgcagccctagtctgaagctgaaagcccaagagcccctgggaggctgctggtgcaagtcacagagtctaaaggctgaagaacccggagtctgatgtccaaaggcaggaggaggggaagccaagtgtctggtgcagcttgggaagagaaagagtgagcagactcagcaaacaagccgcttttccctgttctttcgtgtgctttgttctagccacactggcagctgattggatgttgcccactccacactgagagtaggtcttcctctctcagtccactgactccaatgtcagtctcctccagcaacacccttacagacgcacccagaataatactttatcagccatctaggcatccctcaacccaatcaagtatacacctaatattaaccatcacagaaaacttttagagcatgaaagtctctaacctgtcctctactatgatgcaacctattaattttaggcttgacaccctgaacctccagggtatgtattgcttgttaatgacagtgcaatattaattggcctattagtgctcaatactaatgatactcacagatcacctgtgggaaaacttgccattaacataattgcctccaaggaacttggtcttgcttcattaaaggactccatgtgtgaacaactttttgaagaggtgttgaaaattgacctaaactaatttatcagtttgacctctgtcacactcctgataaacttttcttgtttatggcaattagaggaagttaggagctatatacctccagctacaggtattatgtgttggagaataataagatactaaaaacagtctaaattgaagctgaatcaattagcatattaagcaagtgaaagccacatttcactgtaatgagttcatcagagtgtccctgaatgtctaagagatgggcaacaaggagggaattattcctctaggatttcaaaaggcactttttgattgtttacagaagggagaattgaaaaatctgttttagatttgatcattatcataccatgatgtaatttgaatggacacttaacctcagcccagttctggaaaggtccaaaatttgttatagttgttgttttaacactcaagaaagcttcggatgaggcagcagtcaagccctgccttggtctatggcagggcaaaggtcacagacaaagttgggtctatggtcatgggcgaagtcgggacagaattttctttaccatatgttacaataaatgcaagtcccagactgaattctaccacatgtacaagcatttattaacaagcagacaccacacaaaaaaaataactattcctgtgagcttgggaagttttctctctttatttttttatgaacattggtaagtaccatgcatgaaagtcattccaaaatagatgtaaccacccatattctgaccagccagccttctagatggaaaaggtacatgacatcctgttaaatgggggtggaagaggtaagggatggttgaagagagggtatgttgaaagagggaacaaaataggaccaaacagagttctaagcttgagtgctactctgagagtgtgaatcttgacagattattatacatccctcatgtaagattgagggtacctgtataatcttccttattaatcatatattagaacactcattgatttggggaatgagaaattgtccggataccttttgcactaattaacaaacctcttggaatggattttggatagcaattattgatggtaaattttgaagttacatggactcctggtgagggtccttcaaatgtcaattagctcctcctaaataataatacatataaaggtgtttatactgaagtatatttatgtagatgaattttatagtaaattacagtcagtataatttttttctcatttttactttgtgggaaggagtatggttttgaaaattccatggatttggctgctattgaaggtacctctcaggagctcacaaagagtcaccgcagaaacacttctggcacaccttccatagcagtgtctggaacctctctctcctcaggtgggtatttacaatgtgcctactttgttgtttaaaatgactaaatcaaatggaattgactgctatgtgtggtattaagtggatgtttcatcctttaaaaaataagcattcccttctttgacctatggtggtaggccactccataagaactgcttgaagatagacccaggtaaagctttgggcaccttacattcatgaaaattccatttatttagtacatactcttgccaggtatcatcactgagtttcagtgctacatcagaatatcaatatttgaatgaaggaaatataaattattccaggatacatttgctataacagataagaatgcttgctcagagttcaaggaaatggtagttcaattgatatagtagtcagaagttccctacatatagacaaaagaaaatcattctgtggtttaaataagaagttatttgcaagcagcactaaagtattaataattacccctttcatttgcatggtacactcaaatatgtcattttacttcattatcacaacagtcctctgaagcagctattattcattttgaaatgttaatagctatgactaagaaaattcttcggagaaatttgtcataattttgaagcttatgtcccatacatggaataaaaatcatgatgcagtcttcaacattaaaaagctacctgtaacctaatgattatatatgcataaagcctaaggcaggattctgtttgctgaactgaggggtctcttctagccagccagctcccaaaggattttctaaatgtgtgtggttattgctacattttgctcaggagtaaaaaagctgttcacctgttaattaaatttttaaactagtttagaaaccaacatcatagggtctactactactacttctactcaacagctcctgttaattgagtacgtactctgtgtcaggcctatgctaagtacttctgcattatttttttcatcaattcaaacttaagtacttgattactctctccaatctttctcatttataagtaactatattgatctcagtagtgctttggtatagaactattttgtggaaataagctgtcctgacttggtaagctgtccaaagcattactaagaggtgcattgctctgtaacttatattttcaaaaagtgaaaacaaggtgttcttctgatgaaagactcttctggtccattaagaaatagaacttcctctcattgcatctatagcctctcatttttgtgtgaaaagaacttgctatatcacttcaaagtggcagtttagaataggttgcattgcattttatgtcaaatctgaaaacacagtgaattctctaaatattgcaagcaagaattgttaatgtttttttttctaaatttaagggcccattctaagagagttttttaaagtctaggagcaaagcagttgccttaaacagcttaaaacatagcattttacagtagaacatttaacctcctgtgatagaaggaaacatgaacacctaagtgtaattcggtccaaggcaattaccaaaatattattaaaaatagaagtatgttatcataaacagcatgaagttactgactccgactgttgctttcatggcactatttatgatctgtgcctaaaaagaattgaaataaaggtgaaacacttggaataaaaaatgaaatcttctcacaaaacaggctgactcacgtctttctttttcctttccaccttccagatcagagtcgatctgagttagatttgagtgagtcatttacagaagactcagaggatactgtaagcataagaagcaagtctgtccctggggctttagacaaggtaagttggatgtggaagaaaatataatgaagaggaggaaataagggcataatcttgctccaagtggtttcacttttaggtgatgatgagttgagagtaaagagaggatatacaatcatctcttcctgttagtcttcacagtcaacacataaaaaccgaaagaataacttagaaaatataatgggtaatcatgttaatgagtgaaggttatgtctaagaaaacacatgttggagatttcaatttctggctaaagtcttatcacttaatctaaacctgggaaatgagagatcctaacattttccttagccaaatattattagaaatatctgattacatatttatatcaacattgctatatctcaagttaccaccaataaattcacttctaaactgagacaaaattatgtgaaaattaatgtttcagtgaactcatttctagaatgagaaggttaaattagattattgtaaaggttatttcccagtctaatattctgatattcagatttctgtaattgctataataaaatacggactccttggaagaaatagaacacaaatgtaaaatggtattgatagtttttccaaagcacactaggaaacttagagttctaaaatgaaataatattttctatagtacaaaaaactgggaaaatactttaaaatctacctccaaaagagagatgggcagtgagattaaattatttcaaagtttactcatgttcaacctttaaagaattactaattccaacattattaaactattaaactattcgtgatcttagaaaaccattgaaatcttttcattcattgtatgcagccagtataatcttgacactcagacttgatttttaaaatagtttgaaaaataaaactacaagtcaaactagtttacgaatatacatgcaaaactttaaatataatatcaattaaaatctagcagtgaataaaaatagcaataagtaagttttatgctaagtatgggtggaagaatgagtctatataagaatatttgtcagcataatttatatcaatatactaaagaagaaaatgacatgattctgtatgtagaagatactaaaggatctacaaaaatatgactagaactgataaacaagttcagcaaggttgcaggagataagatcaatatacaaaaatcaactgtatttatatatactagcaatgatcaattggaaaatgaaattaagaatataattccattcataatagcatgaaaaatatttttcaaaagtaaggaataaattcatttttaaaagtgtaatacatgtgcattgaaattaacaaaaatatttctgaattaaaggagacataaataagtagaaacatattctgtgttaatggattagaagattcaatatttttaagatggaaattctctccaaataaatttgtagacaatgcaagcccaatcaaaatacaagcaggataattttgtagaaatagaaattattattctaccatttatatgaaaatatatgggacccagaataacaaaatcaattttaaagagcaaagttggaagacttatactactagatttaaaaacttactctacagttatagctatcagtacaacacagtattggcataagcattggcaatcagtggaatagaattgagattccagaaaaaaaaaaaaaactttatggccaattgatttttggtacttcagtggggaaagaataaccttttcaacaaatcatactgggacaacaggatatccaaataccacaaaacataaaagaactttgactcttaacatataccatgcagaaattaagcaacgcaaaatggattataaacctaaatgtaagaacagaaaccataaaattctaaaagaaaacctaggagaaaatctccatgactttcagttaggcaaagaattcttaaatatggcactgaaagcatgatgcatgtattcaagaaaaaaaactggtaaattaaatttcatcaaaatgaaaaatgtttacacttcaaaagacaccactacagatgtgaaaagtcaagccacagactggaaaagtattttcaaattatatatttgttaaaggacttgtatctagaatatatttcttaaaacccttacattcaatattaaaaagacaaataatcatattagataatgggaaaaagatttggatagacatttaatcaagaagatttacaaatgcctaatagctgcattaaaatatgttcagcaacattagttatcagagaaatgaaaattaaaatcacaatgagataccacttcacacccccttgaatgggtgtgattaaaaagacataataataagtgttgatgaggatgcggagaaattggaacccccctacattgctagtggtaatgaaaaatgctacctacagccattccgtaaaagagtttggcaatttctttaaaagttaaacataaatttactatatgacatagcaattttgatcctaggtatctacccaagagaaatgaaaacatatgtccacataaagacttacacgcgaatggttataatagccaaaaagtgaaaataataatatctggtgaatagatggaatacaatgatatattattcagaaataaaaagaaatgaagtactgacacatactacaacatgcatgaaccttgaaaatattatgctaaatgaaagaaaccaggcaaaactacatatcatataattacatttatatgaaatgtcaatgaaaggaaaattgatagagaaattaaagcagattaatggttgccagggagtgaagaagtagggactgactgcaaacaggcatgggggagcttattgggttgaaaatgtactaaaactggattatattgaagtttgctcaactataaatttgctaaaaatcacggaattacatgcatacaataggtaaattttatggtatgtaagtcatacctctataaagttgtgggagaaaaaattagcagcaaggaaaatagctggaaaagtgataattgttaaaactaggtaatcagttataagggttcattatgctatgctttctattttgtgaatgtttgaattttttaatatccacttttgaaaagaaagtaaagaaacatgaagactggtactttatgtgatgactactgggtaattgtataccaagaaagagcaaaacataaaaatatagaaaaggggcaatttgaaaaaataatagggataatagggatgcattttttcagaattaaagagcttattagtttcggcagctttttgctgaagtttttagagtgttctatatataaaatcatgtcatctgcaaacagacaattttacttcttcctttccaatttagatgccttttatttcttttacctgtttaattgctctggctaggacatccagcactatatggagtagaattggtaagagtgggcatactgtattgtttctgatcttagaggaaatggttttagcttttcaatgttgggtataatgttagctaagagcttctcatgtatggttttatgttgaggtaaattttttctttatctcatttgttgagtttttagtatgaaaagatgttgattttgtcaagtgccttttctgcatctattgagatgatcatatgggttttatccttcattctgctaatgcagtttatcacaactattgatttgtttatgttaaaccatccttgcattccaaggataaatcccacttaggttgaatgagcttcttcatgtgctgttgaattcagtttgctagcattttgatgaggacttttgcatctatggtttatcatggatattggcctgcaattttccctttttttggtagtatccttgtctgactttgctatcagagtaatgctggcttcataaaattagtttggaagtgttccctcctcttcaatttttggaagaatttgacaggaattggcattaattcttcctcagatgttcagaagaattcatccatgaagccagcactttcttacaagatgctattctacaagatattccagctcatcttgtgggctcatcagtgagaaaaaggcagctacaataagttctcatttaacatcatcaacagattcttggaaactgccactttcagcaaaatgacatataacaaaaccatttttttcctcatcaatgttttaatgaaatgacattatttgaggacctgctgcacatcctttcacttaaaattacagttttcaagaacctatggatgacgttaagtgacaacttaccataaaccaatataaaaataagcaaattttgaacaagtatttcacaaaacaggaaatccagttggctgattatcacaaaatggtattcaacttagtaataagagaaatgaaaattaaaatcatgaagactgtaaacatctactggattggcaaaaatgaaaaaaatatctaacaataccatctgtttgcaggcaaggaagtggagcaaagggaactctcatatactactggttagactgtaaattggtgtaactacttctgaaaatttgacattatctttaaaatgatatagataagcacgtggagatatgttcaccccttgacttgacaattcctctcactggtatatattcaagtgtgtgaacatatatactgtgttgtgtgtatactgtggtgtgtgtatatgcgccaggatacatattcacagaatatacatatcagtgttggtcacaatagaaaaaaatctgaaaataacccaaatattcagcaacaagagaatggataaagttttggatatcatacaatggaatattaaatgacaatataaatgaacaggctacaaaaatatgccacaattttgatgaattttaaggcaatattaagcaaaaaaagcaaaactcaaaggaatatatagcatttaattacatttacacaaagtacaaaaacaggcaaaacgaaatcattttgtttcagagtatacgcttatgcagttaaactataaataaaagcaagaatgtggttaaccataagagttaaaatattaattattcccgaggggagaaggggcttgtgatatggacaggatacacagggagcttctgcttcatcatttgattttgttattatactatatatctatgttttatgtactttttaatatgctgtatcttataataaagacttttttaaagcaagcccagaagtgtacatcataatcctgatttataaaactatagttaaaaaaattcccatgaatgtatacttatactcagatttgtgtatgtttttatatgatttttcacataaacaaggagaaagacatggaatgtaacatgtgcagcaggatgctaaatattaatttcacctggtgtgaaaggaggggaaggaggagaggagaagcaaaaaagaaaagtgcccataataaaaagcagtatgcatgatacaatctatctatgtgtatatatgtatgtgtgtgtgtgtatatatgtatgtgtgtgtgtatatatatatgtgatgatataatcaaaaatattgaaatttgatcattaatatgttaatgagagacctaagtttttagtttccatttatctatattgcttgaaataattttactaggaaaatacatcacttaaataactaggcaaaaaaaaaaaaagccattttatcatgaaggagaaaaagaaatgggaaaggaaaagtagaatctgggattggagatgagagtccagtatctagttcatcctagtggagagatttttgagatatgctttaccatcttggcagtgtgtgtgtgtgtgtttgcacacacacacaaattttttttaattttaaagtaacgtaagtacattgcccaacatgaatcaccttagaggtaggaattgaacccaggtctgtatgattccaaatttcatgttctttcaataaagtaagcaccattagaaaggagacctcactctccaccccctatccctgcccacttctccgatggtataattcagattgaccggagaggaaaagagaaaaacctaggaatggagtgatttctagaaattttttatctgattctcaaatatttatgaaagaaagtggtttctcaagtgaaaaaacattctagaaaaacaaatcaaccaacccactgatttttccctttcttttttaggactccttggaagagactgaagaaagcattgatgccttagtgtcctcgcagttatctacaaacactcaccgtctggcaagtggcctatcaactgtaagcagttcactaggacatgtggaaagtttcttttccctctttttgattttctgtgcatttccaaaggagatatgaatgttcttaggaaaatgtgtgataatgagttaaaagtcattgtaagatcctgcttgccctttgcccacagagtacatttcagtctaatttggtgtgggttttttctcaggctcctgatttcttccttcttccacagtcctcacccaggttttaaaatctcctcactccctagttcaggctcagtcagctcaagcctataaattatttttcaattatctgctgacacatttccctgacaccattctctaaacttcccagctgtcctccagactgctgccagtcatttatcctaaaacacatgcccaatcaggtctgtcttctactcaaaacccatccatagcttcccactgcctacaaaataaagtcctttcttactttagtgttcaaggccttttttgagaggaaggccctgtgtccttgtatctaactgtgtgtaagtctttttcttggcttctctgatttctgttgctctgatgctttttttcttttgatctttggatgacttctctaaagagttctcaagcaggttctgacaggaagtggacctacctaaatgtgcctgatgctgactcagacactgtgagttttcaacctttcctttttgttctttccaaccatacttcacaaatttcatggtctgggaactatgattaagcaatttgtcccacatttatctttttccgacttatatacaattaaccagaggttatcttctaaaagattgatgagatgatcagaaaccaagtattccaattcattaaacattggaatctgaacaccactcaaaagacacatgctctaaaatgattaactatcaacaaaacctttgaagtaaacaactattttaaatcacagccttagcttggttaagagcatatagtttagttagtagtaaaattgccataggtgtcttagtttctcacaagcctccgtatttgtgggttcctaaatttccttctatccgtaggggccctctgcttacagaggattttctttgaaaatgtggctacagagatctagtatagacacaaatcagtgatataaggaggtaatcaggtatggtggggtagtcctcagactagaaacttggagatcttgctttatttcttggccataccaacaatttttgtgagccagaattttctcatttgtaacatgagtaggttggggtttattcttgaaacctttgatactcaaagcattctctatggaccagcaacattgcatctctcggaacagataccccaaaactttctcagttcaaaaagcccctaatgtctcagtaattctttcctggcactcctacactaaaagtagcacctgactagtccattcattaagtagttagaaccaaataatgtaataagcagtgtatcctaacaacttactagccatttgtaaaaaaatgctacaagtgaaagaaattgaaagaaaaatagtatttttatttcatccttaaatagcacctattacttaccactaataggatatgtgtgcctattgagcactacacagttaccaaatcttggaatctgattggacatcactactttcatttcccatttcacattgatttttatgcaatacttgctttttgttgcagcaactgccaaaaactcagcttcagacaaataggagttcattgaaaagaataaagtgtggtttaaagttgacactgtgaattactagttagtggcttacatggtgtctgataggtgttgttgtgtttcccttgagaatttaaaatatttctgtgattcccctgtgagtttgctgtggtgctctgtggtacctcgatacacagtttcggaactgcaggcctaggagtttgttagaacagccaaatctcagacctcaccccagactgaggagataagcgttttcagtttaaaaaggtatctgggtgctgctcaaagccacctgctaaacatgaaaattctgttgctttgttttaggaataagaaagacagattaggtcactcactggctttctttaagctgtaatttccaaataattatggaattattggtctgctcttgcccgtgaagaagcttagaagacatgtgaccacatcacccacatcctgttctttggtcagtctctacttccagaaattggtggaacataatggcttttaccaaaagcaaattatgaaaaagaagacagtctaaggtccctgtgtatttaccatagtcttgacttcccagtggttcacagaaaagtggttttgaaactattgggtcatccacgaaagacctccaggtggtcttttgtgacagttactgagatacatagttttcatttctagtgccaaaggataattttattacatttacagtagtcacctttatccacagaggatacattccacctaccccagtggatgcctaaaacctcgcgtagtaccaaaccctagccaagaaacaccaaggtcacattttcacttaaagaaagcacttttggcttctctttgacatatgtaaattactaccatcattactcttacactgtggagtcattattaagtaaaataagaatgagttgaacacaagctctgtgatagcaggacagtcaatctgataactgagacagctaagtgactaatgggcaagtagcatctgcagtgtggctcctacagtgtgtccaactggacaaagggaggcttcacatccagggtgggatggagcagtatgatgtgagagttcatcatgctacttgtgaaccccaaaactctgaggcatgtctcagttaatttagaaagtttattttgccacggttgaggaccggcacccctgacacagcctcaggaagtcctgccaacgtgtgcccaaggtgctcagagcgcagttttgttttatacattttagggagacataagacatcaatcaacatatgtaagatgaacactggttgggtctggaaaggcgtgacaacacgaagtggggagggagcttccaggtcataggtagataagagacaaatggttgcattcttttgagtttctgagtagcctctccaaaggaggcagttagatatgcacttatctcagtgagcagggggatgactttgagtagtatgggaggcaggtttgctctaagaagttcccagcttgactttttcctttagctttctgattttgggtgcccaagatattttcctttcacatactcaaaacagcatacaatttaaaacttatgaattttttgtttctggagttttccatttaatatttttgaaccgcagttgaccatgggtagctgaaactacagaaagtgaaactgtggataagggggactactataaattaaaagctgtctcatgtcattagtgtcttgtcaaaagcctcattcattctggtagatttggacttttttaaaatttattttcctgattggttggtgtgtgattttattgtgtagtagtttattttgtgggctgctactttatacagatttacaaagccatggtcatatactactcatgtagccacacagctagctactcagttgagggaaatcatggaagctgtgggtatgtgatgttcttctgatatgtccttgttaaagctgtagttatggctccccggagactgatgggatgctccatgtaggtgtcaaagaaagcagtatgtggctcctgctagcacagaatatgagataagctaccctttgtcccaatcaatgtattctacaccttatagtagattgaacttgagtctaacagtgaaaatggagaaagctgcagagatagacgagaagtgagatttgaaatgcctcaattaccctgtattcattagtagaagtgagtaagcaaagggtattctctaacccaagaaggaaatgcttcccctctaagcaaattttctgccttttttcctgatggtactagatctgctgtcttttctccagctgggattttatacaacaccagccaaacaagtgactcttgttttctttcctcaccctagacttccatgctcattataaagaacaggaactataattgaatgaaatgagttgattctgtgaagagatcattagaatgacactagaagcctttttccatcttgtttattccagaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcgtaagcacatagcatgttcctcagactatttcagtcactgccttttttgtctgtatgtgtgtttccttttcaaaagagtcttagcattcttcttgattcagtcttctcagagagttgattgtcatgttcctcctataccacacttttaaatattctctgaagcaaatgtatactggttgtgtctttgattaactgatttttaaaacataattcaggattgacatatttgcaatttacacagaggcagctctttgaagtagaatgctgacatgttggcacacccaggatgtacaaaagcatcttgtcgatttctgttctgggaaatcctccagagaaaattaccaaactgttacccaattaaacaactcaaaagggcaattatgaggctctcaggattctagagatcagcctgggagggcaggtatggaccatagcacactggagagaagctagatataaaggtgtgtcaggggttctcaagaccactgccaggttcagtgattcactaggaggacttaggactctgcacgcagttataatcagcaaagaggcacatggggcaaagtccaggagagatcaggctcaagctttgcaagggtcctttcccagtggagtcacataggatgcatttaattcctctggcgatgagttctgacaacatctgtgaaatgttgtctgccaaggaagcgtgttagaaactcagctggtcacataccaaatttccagtctctcaggagaaaaagaacccgttcagcataagccatattgtttgtacaaacaatttaggaacaacgagccacttttatcagttctgggaatggtgggaatcctgaaatccaagttgccagatgccacccaagggccaaatttgtaagcaggcatttagaagaatggtagtctcaggcccactatgttaactcttttctgcacaatagatgacctaagtccaataaataactcagtgaacctggttccaaatcccctaagatagacaaatgagtggattttgactacagattggtccacctgcctcctcagctacatttcagagggctacaggaccaatgtaattattttgactggcatggaaaggggtcttctaaaactcaacagatattctgtagaactttggtagcatcttatacatttcagctttgtacacatcttgtacatttctgagtctgctgtgataccctgcttcaagaggctcctgagatagctcaagctaaagtgttgggtagaattgctatcactacttcaggttgttattttttattttgcctttttcactgttttcttttactcacccattaccattgaccccactctctgacatcagaaggcaagactagtaatagagaagcatctaatcccagaaaaatttgtgagaccattaatattaatagtgtattacatgtattgagtagtacaatatggtagctccttggatgtgtcaactaatttaatcctcacaaggccatcagttagacagtgttattttcccagttttacagatgaagaaactgaggcacagagtggttatttagtaaattcttgaggtcaccaaatctctgaggcatggagtgattcaaaaccaggtggcttgacttcagaacccacactcttttatcattatactttaccacttctctcttacggaaggcccagtgttctattttaaggtatcctgttatatagacaaaattctctttggtatttccgctcatgctcactggccctttgccccttttattcacagcgaagtctttgaacatttcttgcaaatagatgtttcacaataattacatttatattttcttatctatagttatgtcaagtcatatcttcttcctgacaagtcccggaacaacaagcgtaagaccaaaatcagaacaggcaccaatccagaattcaatgaaacactaaaggtaaataaatacggtctcatagtaactcatgtggtactgttcacaacttcaatggtttagaagtaactacagagaatattttatttgtgtgtcaaggcttgtatatgttttagaaaattagaatttgaataaattaacataataaccttgacttttctaacatcttttgagaaaaagaaaacactcttactctatttaagtctacgctgctactgaatttgaaccttgagtagagaggatccagccaaactgcatcggtgctgatgcttcttgctaaaaaatcggttttacctttgggcaaacagtgctttttctgacttccgtaaaagaagcttgtcacagttttgacactacttaatgagtcactttgcacgcattcattgttctgctaacatagcataggtctatactgtttgttgttaggatttcagaatttgaccaaatgtaggtatgtggttaatgaatagtggaaatgcagagccagatttgagaaatctcagcaaaagtagcctagataaaatatggcccaatccaggtcaatgatccagaaaatagaaatctctttccaatgcgctttcacataattaaccccttctcttgctatggaacaatctggcctggtaagaaacacccagggaggatggaaagcagaagttattgccaattctatggaaatttatgggcttgtgccccagagtgatggtgtcagagtccactttaggaggaaattggtaaaggcagaaagccacaagcctgcatgtgtcagtgggagcgtgtgtggaagcaggaactaatattaagacagaacaaactgaaaaatgaataaatacaggtagagagtaaattcaatggccataacaggataggaaagatgagcccaaacacagtgagagggtaaatttaggaagcagggagccaaggttaattatgacagtaacagcaaagacaagaataggcactaatccaagatcaggaatcagtcagtgtgaagtgtgtcccagatggtggttgcatagaacaagcagaaggctggagggtgtgtgagcatgtggccctggatgatgttgttacaaaaaacaaaaaaaatgctagcccagcaatatcttctttctgtttaatatacatgtacaccttttcacctctgcacttaggctggactttataaaatttggtgtttgcgagtttctcattgtcaatccttttctggatttggggattctcattatgaataaaataagagagaaggtggagaatgtatatattaaaccttgagcttacaaagtaggtatgaaaaaataattaaggaaaatgaaaaaccaataaaactggaaagaggataagcttcatcacctaacactttttatgcagtatatggagtttatctctacctcagataatttgtttatatatctttcaatgcaaagtctggcacaaaatgagtttatggcatagaacttcaattgtagcagaaacaaagaaaaacaaagagttttctttgtgtttgttttgttcatattactgatgcatatgatctgaaagatgttggaagtaaatttcgacctctcctggaattggatagagccctccttgtggagtgtaatgttgtaaatctcattcgcagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtaggaaatgctctcagattagtcagttatgcaatgagacaagttatgagcgaaattgatgtcacagacctaaagaacttgaagactttcaaatttcaagtgataatctgcaaaaaattagtgcagcaaattttggaataatattataaaaatgttgtaaatccaccgttttggaaattctttgtcaatatagatcatctgtataatgaaagctacataatcatttttttgttaaaaatttttattatttgacagtctcattggataactgaaagcaacacattatatgatcttattagagagtcttcattttcacataggcgaaaccaaattcatacagcatgaacaatccccaaacattacctttatttctcattctccacaatttataccacaaacaggagtgatcttgcctttgcttatatgagggaataaccagtagctaaagtatctgattttcttactttcctacttttgggattcatgacccaggccttgagttacattcagaaaaaaaatcttagagctgataattaaatgccaatactgtatagcatgttctaatctagaccaacagtaccttggattcactttaagtgactggagtctctatgcatttacagtactttttaagccaaaatggaggtgagtaaaggtcacatttatgcagccaaagattattgtttatatacagaaaggcaaaagcacattatgatgaagacagtggactcaaatcaaacttacttggttctatcctggcttcatgactgcccatgtgaccttgggcaaattatttaactttttattccttagtgtcctcagttataatataatcgtgggatgtagcttataggtctgcggtgaagcttgaataaacattctacgcatggccgtcagcattttattgggaacattgtaagctctcaataagtgctagatagtatacgtgttacttgggagtccttgtactgcaacagacagaaactccagctaatactgctcaaaaaatagagggagattattggccagcagtgattaggcatagcttgatccagatgttcaaatcttatcaaagtcttggaatttcttggtctctcttcttatcttcattggcttcattttcaggttccatgcagtgttgccctccctgactagctccaagcatgcctctctaatgactacagtggctgcaagcctttcatctttgcaccacactgttcagaagaggagagttcctcctcctccaacagccaaatcagtgcattgggcctggttctcctaattataattctgtcatttgcctattctaagctattgactgtggccagggaggtgagatgcattagctggcttaagacaatcagaatataccctggttctgaagaagggaacaatagcatccttccagtaaatttcctggaaatagttgaaggactttgctggaatgatatctaagctcccctagacctctcctaggcatcctttgtgcttagaaatcaacattttccacagtaatcacttccacattgtcaatgagtggttcacagtctatcataagagggaagcatctctaagtctttctgagtctactgaaggtagaaaagttctgattgcattcactgtggaataccatgggtcctctgccagatacccttaggttcctaaccatgtcttttaggagatttgccacaacagcctccacctgagactctctttagaagacttccctcgggctactgtagctttttgcctatgtaagcagagagccagaagtcctgggaatttttatacccgctgccacaagacaacccttcatcaataactgataggtgggggagtatgaaggcccacttccttactgaaggtgggaaaaactccaaagtgttacatatactaccacatcaggtggaagctatcttccatggaattatgcccaagattagacttgtccctatagacttgcttcccatacctctttactggtctctctgagagaacttccttaataaatcacttcataagaatcttcaccttagagtctatttctgaagaacccaacagaagttagtgtctctaatctctgccatcttcctctgcccagcttcctctgttctatatagaagaaaagctgaagacacaaacgtgcttagatatcatgtcttccataaatggggaggacaggcataaaggcatgctctatcatgctctatatgctgccttgtgcttcattagtggctcatccccaggctgagctgggctctgtgtggttgattatcagccagctatgtgaagtggcacttcagtttcagtttcctgcctcggtcatttccatgcaattgtcactccagcagctgcagatgtagtatgagcagccttggagacttgacgtttctcatagattatgcagtcgagaaggtgaaacatgagttacacatactgatttccctagtaataggggatcagaattaataatccttaataatttagaaatactgacatacttctgcactaggagttccagaacggcatggtgccttattgcttattgactctattagtgaaggttcctcaatatttatctttgtatgggttagatcctacagtgctaagccagtgaggaggctggtgcagagaaagaactcaagatgccaaacatactgtagtttcacagtataacttccattttacttcatggcatgggattatttattagctgtaaagccttctgaaaggcatgtcaggtagttagacaaggttttatcagtatgaattgcctttcatgccttcccagagtgtactattataaaaacaaggacatctgaaaatcaacagcaagcttacgtggttttccaaggaaacgttctcttattctgccttcaggtagagagtaaatgtatgttcctttggaattatacctagattaaaggctctctctttttttggcagacttttgtctgtaattccttactctgtgttacacctgtaaatgcactgggagtctctttctcactccgatggaaagtggacctctctttttttcagaaagcaggaggtggtgggtgtcatctgcttatttcacatccatgctcagatagtctcagtggttccctactacttttggatatggtttgaataaatactaaccctcaccctggcactcagtgttctgttgaatggcccagcctactgtagcagccaaagatgttagttctctacccatccccgttttcttgcaaacagggctccccacttctttcactcccaccagccaacccctgccaatcattgtaggaggggagccttcgggctgctagagagggcttggtttgcaggccagaaaagccaacatagcctgggtatttaagtctcctgggggtgagcagagccttgatcaatgactggtggattaaggaacgtcaatactcccacgttcttgcctctgattggaacagctctgaagtgtgatctgtcacatctccagagtacccctatgggacttaacaacagttactctccatggaactttgcctgaaatcacatccttaagcctccttcacttttggtcccccttccccagtacccttcctaataaaatactataacttaaataagtgccttagcatcttctgggaaaccctgagttgacaccttattttcatcctccttgctactacctccctgtacacactcccctgatcacatttgacttcctgtcagtccctaaacatattctacacaacccccatcatattttactcatactgctttctcaacctggactaaccttcccaatccatcttcatctgtcatcatgtctcccatcctttaaggaccaggtaagagccacctctttatcccaatctggattaatctttctcttcccatagtagtttctttttacttgtgttggaataactgtcaccatttatcttacattgaactttctgtatagtagaaaccctcttgccccagaaattacaaccagtagtaggtcagttaatagacaaagtcacagaaatcacccacatacaaacacacacaatatatttcttttatttttaattattttgaattgacacataaaaattgtatatatttatcatgtaaaatatggtttctaaatatgtatatattatggaatggctacatcaatctagttaacatatatattacttcacataacatacttttttgtggtcagaacacataaaatttactctcagcaattttcaagaatacaaaacattgttattattaataactatggtcaccatgttataaaatagattcctcaaatttattcctcttatctagctgacattttattttgttaggccagcatctacccagttctccccacccccagcccctgataaccaccactctactctctgcttctattaattcaactattttagattccactattttagatttatatctattttagatataagtgaggtcatgcagtgttcatctttctgtgcctggcttattttaattaacataatatcctccagatttatccatgttgttgcaaatgcaaatgacaagattttattttttaaggctgaatagtattccattgtgtatatataccatattttctttatcacttcatccattgatggacaattaggttgtttctatatgttggctattgtgaatcacgctgcaatgagcatgggagtgtagagatctctttaagatacttatttcaggccgggcgcggtggctcacgcctgtaatcccagcactttgggaggccgaggcgggcggatcacgaggtcaggagatcgagaccatcctgggtaacacagtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagatacttatttcaattcctttggctatatatcttgtagtgggattgctaggtcataaatatggtagttctataacacttactatatttagtctttttgatattagccattctaacaggtatgaggtaatagctcattgcaattttaatttgcatttccctggtgattagcgatgttgagcattttgtcacacacttttggccatttgtatgtcttcttttgagagatgtctgttaagatcctttccccattatttaattggattatttgttttcttactattgaattgcttgagttcctcatgtatcttcgatattaaatgatttaacttaaactatatcagatgtatgatttgcaactattttctctcattctgcagattgtctcttcactctgtcgattgttttctttgctctgcagaagttcagtttgaggcagtcctatttgcctatttttgcttttgtttcctgtgcttttagggtcatattcaaaaaaaaatttcccagacctatgttgtggagcttttcccctatgtttttcctagtcgttttacagtttcaggtctcatgcttaagtctttaatccactttgagttgatttttgtatatggtgtgagacaagggtccaatttcattcttctgcatgtggatattcagttgtcccaatactgtttattaaagagactgtcctttccccattgtgtatttttggcacttttgttgaaaatcaattgaccataaatttatttctggactctctattatgttccattggtgttatgtatctgttcttatgccagtaccatgctgttttgattactatagtttcccaatgcatttcttaaacatttatttttaacttaaaccaaataaatgtacgttcatttgcaagtcttctgatatagaggcaattaattttgtttgaatttcgttcagtaagtaaaattctgccatatattccttgcataaattctcctcctaatgcatcatcatcagaagattctaatttgagcttttctcaaatgaaacaagaacataagaatactttcaaagtaaacaaaatgcaaattcttctaaaaaatgtatgattttttctaacctttgatagattcaagcccacatataatccaatagcaactttgttttcaaatctttagttcttctattcaactgaattgttatagtagcagctgtctttttgcactcatcaatttatgtgactttaaactatataattaaaatcacaaatatgcctggcctaaagagcttaggggactaactaatgcagctgactctcagtgtgcatacaattgaactgatgggagcagatgcatgttctttgcagaaaggattctgctattcacgagggatgaagaacactaattaaactgatgagtcagcagttaactaagtgtgaattaatagatcctgctactgcaaatatgtctactagatagactgaaaactcattgaaagcagggtctgtcttttgtgtccccacagcacttagcaaaatgccttataaaaatgtaagcattccatatgtgttggtagagttgaattgaatatgattggattctgctaactttttctgagtaatagtgggttggataatgacaatggtggtatgccaggagagggtgttgcctaggaatttcctggcaaaatataagtatcaaaaataccctaagacattagacatgtgcaggctgcaatatgactcccctgctttaattttttatatgtgattataatgctacaagcttcatcattattgtgttttcctttcataagacttgaagtctatatttatacggggtctacagtatattttaagctaaaaaccaatggaacattggtaagtcccaataatgcatgtttttgatctctggtagcacactatatattagtatgtgattcctacacatataactttttcctactggcgtattttcatacccgaagatctcactcaaaaagcaaacacagcctgctctggttaactattgctgtatgccaaactaccttaaaccttcggggcttacagcaagaatttattctctctcatgattctgtgggtcgactagactcatctaggtagttctcacttagggtttctggcgccactgcagccagatggttgactgaggctgatgtcatctgaaagctcaactgcattgattgttcgagttggctcacttccatgtcttacacatgatgttgactgctggctagaaactcagctaggcctgccagctggagcacctacatgcggcttctctctgtggctttagcctctcttagtacgagttcccagaggaagcattcggaaatatccattccaagaaagaaaagtagaagctgtcaatcttaagacctggaccccaaaactggcacattgtcacttctgccatattctataatactagtcaaagcaatcacagagcccacacagacccaaagagaggtcacaaataccccatctctcattgatgacggtaccaaaaaagtggtaaccatctttaatctgtcataacatccattataattttctacttatgatagtcacctaaactaaaatttactgagattgtcaaaacaaaaagaagagtccagttacaaggaacctgatctaaaataatcagattaaatattagatggatagtctattttaccatataatctcatttttgccccgggtaagaaggttgaataaaatatttcaagcatttttcccacccttactagtaagttttactaccaccagcaggaaagaaaagggaaagtcaggcaaggattccttttctttgtaacagtctcagtatttttaatttttttttactgtttatttgcttatttatgccaagtcttgaacagtctctggcttggctatgaatgagctaggtttcgggactctcattctgccctctctgagagagcagttctctgcttttgactcagaagtcagatccctaaaggaaaagcctgacaaagtatactgcctttcctgctctacctgtgaaagaactcaaagttcagttgactcaatggcaagtgggagacctatagaatagaggttctgggtgcacgtgcacattgactttctttaatttaaactttatattttgagatgattataaatctacatgcagttacaagaaataatatgaagagatcctatgtacccaatacttgattttccccaatggtaacctatagcaaagatgtactataatatcaaaccaggttttgcttatttttttagaggcagggcctcactctgtcatccaggctggagtactgtggcacaatcatagctcattataatctcaaatttctgggctcaagctatcctcccacctcagcctcccaagtagctgggactacaggtgcatgccaccatgcccagctaatatatatatatatatatatgtacgcatatacatatatatatatatatatatgtacgcatatacatatatatgttgagagatagggtctcactgtgttgcccaggctggtctcaaactcctgggctcaagcaatcctcccacctaggcctcccaaaatgctgggattacaggcatgagccactacacccagccacaaccaagatattgccattgatatgattcaccaattttattcagaattcccagtttggtactcatttgtgtgtgtgtgtgtgcacatgtgtgtgtatatttcatcctatgcaattttatcacctttataggtttgtgtatctactaccacagtcaaggtacagaacagttctaataccacatgtccctcaggttgaccttttataaccacatctaactccctcccactactcacatccctaacttctagcaaccactaatctgttctccatctctataattttgtcatttcaagaatgttacataaatgaaatcataaagtatatgtcattttaagactggcttttttcactcagtataattctctagagattcaacttgttgcatttatcaatagtctattccatttttattaatggatagtattccatcgtatgaatgtaccacagtttgtttaaccattcacctgttgaaggaaatccatgtggtttccagtttttactattacaaataaagctgatacaaatattcctatacaagttttgtgtggatataatgttttcatttctctgggataaatgaccaagagtgcaatttctggttggatggtagttgcatgtttagtcttacaaacagtcttacaaactgttttccagagtgactccaccattctacattcccaccaacaatgtttgagtgaaccactttctccatgttgaattttgattatatgaattaccaacattgcttttaacagttgatggctggcagccccatgtgaatcaagcattattgcctacttttccattcttgatcacttgggaaagacttaaaagacatcaaagatgacagggagaagtaatttctggaggtattttcagtggcatttttattcctgcttcttcatatcccaaactatatatgtaaactcagtgataggtccagtcatcaatgcatcacaggtgctcaatatctattgactggccaaatataagttatatgtcttctttcaaatttcttttacttaaatgttaaaagttatatgcaaatgccttcatagagttttccagcctttgttttctcttacctcagtcatctcttaaaccagtgagagcgaacagagttgaaatgagaatggattgtcacatttatgccactaagtaaatattgcacattcaaatgtggactacaatactaagccaatcatccatactctttcaacttacttgtttctccttggccaggtggagtttgctcctgatattggccttcaatacaaaggagagctgacagttgttttacgttacattcccccagaagagaacctgatgcttccaccagaacaactccaaggtagagtaaaaatcaatgactttgatcaatgacattctgtttctagaagtgtggtagtgggactcagggattggttgcattatatttctttcatattacacaaacaaaacataaagggtttggtgtcactgtcttttggggagagttgagatgtgtataccgtatatatagaagaatgcaggactcttacaaggaatccttgtaagattcatacttagaaaccagccttggtggtcagttttgttttatgtcccaaagatataggatcttcccccagggttgggggaaggcaggctgctggaggcaagtataggaaactgctccatggatttatgacattcacagctattcagggagtcttgaggaagaagttgatctagaacacaggatttaaaggaaaaaatcagatggaatcaatttataaatctctcttcccctttgtattaagctgtttttgcattgctataagaaataccaagactaggtaatgtataaagaaaagaggtttaatttgctcatggttctgcaggctatgtaggaagcataaaacaggcatctgtgtctgaggaggcctcaggaagcttacaattatggcagaaggtgaaggtggagcaggtgtctcacatgacaggagcaggaacaagagaaagagagaaggtgccacatacttttaaacaaccagctctcacaggaattcactcactatcatgaggacagcaccaaggggacggtgcaaaaccactcatgagaaatccaccccatgatccaatcacctcgcaccaggccccacctccaatagtggggattacatttcaacatgggatttgggtgaggataacatccaaactatcttgcccttcttttaccatcaattcttgcaggcagcctcctctgtcctcccattcactattactcttttcagtgtgaccctgtgcaagtaactcactatcacctgacctcaatttcctcacttcaaagggctgttgtgaagaataaacaggttcatatatgtaaggtgcttaaaacaatactaaataaaggtgctggttgtgatactggtttatatcattcatgttgaatgtatttcataagaaaagaaaagtgaggtggaaaagagatttctctcaccctaaaacgtaactgtgtttgggctgtagcctctagagctggctctgactaaaactgactatttgtaagactaaaatatcaaagggagttattgaattttctctttttgagttttggtgcatgtatattgtcttcatcatagttatttctcactaagagcaggaatggtgctccgggaaactcttaggcattccatgcctttataccctgtgaaaagatatgctttgtaagggagtgtttaaagttttaaatttatttcttcatttgtttcaacaaatacaaatgaaagacctatctggaaggaatccaatgggggcaaaaatgtttaaatgaataaaaatatacaataatgtaaaggcccaaattagtcagcaaatgaaatatatgtttgtagatgatctttgtaaattttgaaatggaactcatgatttatctatttttttttctctttctccaccattccctcattttggtggctgacacaggaaataagacttttaaaaagggaaagaagaaggagtcacctgtaatctctggaggaatactagaagtgttcatcaaagaggcaaagaatttgacagcagtgaagtcaggaggcacttctgatagctttgtgaaggggtaactttgttttagctctttttggatgatacttaataggagatgaaaggatctgtgatccacaagccactggtggctgtgagccttccgtgttctgtttactagaagtgtatgggtgagaactacccttacatgctggctcttacatctaaaataacacaagtgttgagggaactgctgattctagctgtcactctgtttccaacatatttcaggaattcccatcactcttactctcaagacagtcaacttttttctgtaagattcatttatcgaaagtggacaaaagtatgatttcctatgtataatgtatttatattgttctttattatcattttgtcctggcaatatgcaacaatcaccaaaatatcagatccttgatatttttctctcttgggggaaattgtaaaaagtagagatgtcagagcatccttgctggacttattcactgtcgagtgctttggagaggctccaagaccacctgctaggcatttgtgcccaagttgtggagcaaagggcagcttcctgagggaatgcagccttaaaatggatacttttgcctaactctaggcaactcaaacatcaaatcccttttgattcctgactactggatatttttctcttggaaattgagaaactaagactgcaaggttatttttcagtcattcaaacaaacacaaaatgcacatgtgccaagcaccaggtgctatgctttcaaaaataaataacatattatccctgccctcatggaactccgtaaagcacataaggtaaaacaaattcccatgatgccagaccatgaggttcattctttgagtcggatggcaatattgttcctcttcacatgctgtattggaaaagagtattttttcctacaaggaaatgggttgagctcactctcacatgttatttgttgttgttgtttgtttttgtttttgttttgagacagagtttcactctgttgcccaggctggagtgcagtggtgccatctcggctcactgcaacctccgcttcccaggttcaagtgattctcatatctcagtctcctgagtagctgggattacaggtatttttatttttatttttatttttagtagagacagggtttcaccacattggccaggctggtcttgaactcctgacctcaagtgatctgcctgcctcggcctcccaaagtgctgggattacaggcatgagccaccgtgcctggccacatgttctaactttggtaaagctagtagtggggagaagcagttctggggcctccccattggtgagtgtgtatgcctgaatcctggcacatcttcccttcactcttccttgcagtagatttaagcatagaagaaatgctttctttggatactgcagttacaatttgtgtcattagccctaccatccagtttaagcttctgctgctggaatgaggagatgactcccaacccgtggccacattgtgaccttgcaacggtacttgacatcttctggagcagtattcactttatcttgtggaaaatgtataaagcagaaataataaaagacagtatttttgttctagaaagaaaaacaaaagccaataactttccggtaaattctgtctataataatacttaaatattaggctgattctaaaaagacatgagatttttttaaaagacagtgagggagcaagaatagaccctctgtaaagtttaataatataaaatatatccattaacattaggtcggtctgtgagccaaaagaacagtggcttaaacaagacaagttttttttctctcttacatgtaaacaaagactgaaggtaaggtccccagtgcaggtatggaagcatcatgattatcagggacccaggatttttccatctcgttatggtatccacctaatgggttaggatagctgctcctgtttcagctatcccacacaaattccagctgacaggacactttccagatgtaagaagtagttttatcagcactacttcttatatcccattggccagaactcagtcacatggctattccagctgcaagggaggttgggaaatgtagtctttattctgggcaacactgtgctcaaataaaaacacagttttttagaggaatataaggagagaatggatattaggagataataagcagtctttgcttggtacatgaaattaaatcttaagtgacttaatgtatcttctttattgtaaagtcatttgcttgtagcacttttcgtttttgttccatgtactaattccatatgtacatatgtcttcttttctaaagtatgctccctgaagggggaaaacagccatttttatcacatacctagagcctcatacagtgttttgaccatagtcgagaaaacctaggatacaggcgttttatttgaagacaaatttcaggaaacaccagtgaggaagtggagaaaatgaaacaaggaagaaagagaagttgattaaaacatatgttaatgggcaggttaccactgtgggcaactggagcatgattccactagggaagcagtgaggaactctgtggaatataccttaggattgtcactttgagggacagggaagatggggaaattatccaccaatttctcaaactcatcagttaaaagttgccccaggggtattaaattccaagtaatcccagagtttcctacacataagctgagccagctaacacaatatcagataaattccttaattagaggaatttattccttgtatcaagagacacaagcacttgaggtgggaagctgaaagtatatcaggaacttcccatcctggctgcaagtcagctccaaggaggccaaaaagatttgaagcaaggcattcaatagtgtctattacaggaggtattttcttttcaagatggaaggaaggacctaaataagattagaaaggagagtgagggcattttactaatgtcccactgggaagaaataataagtcagttcactatataaatccagatttaagcatatagaagcctgggaaggaaaatcaaatagacacatcacacttgtgtacacgctgacattttctgtctgctgtcttattgatgatttgattgttttttctcatgcagctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgagggatttggggacccacagggatggtctgtgactaggcccaggtgggggcgctattcttgcagatgtgatgtgcagtggatgtatatatatagtttcagctaaatcctgaaattaccacaaatacttcattcctttagctaaggatctattcattgttaaaatacaaatataactacagtaactttgtatccttaggctagaagattggaagatatcatatttatattcaatcctttcatagactagcatttacaccttagtctaagtgaattgtaagtactttcttgggccttgcttcatattttgctcaggggatgattaccaagacagcataggcttctgatgggaggagagcgactttcaagaccaacattacttcatcatcttctcagttctgtccagcacttgcagctattattcatactggttgaattgaaaggaaatcattttttcataaaaataacaccagtattgttaaaaacagatcaaggaaacccaccactggtgccacaagacgcaactgtaacagggtgaattggaagagggattacagtagtagagcacgtgcattcccctaactctcattatcccatagcctaagccagacatagatgagaccatcagcatacaccatggtaaacatttctgttgaggaaggtcctatcactatgataattacttatttatagattaaggggagccaaaaatatctataccactaaaaggaaaactccccaggtcagaaaagtgcccttgttagaaaaagagagccaaattcatcccattcttctgtcatgttagcacagtccagatgaaccagctctctgctaaagtagggaggaagtgagtcaccagggccaccccgatttgcctcatatggcctaggcattagagaatagtgcaggctgaaatgattgattgattcaattctaacaccactcactatatatactaagtgagaacaagccagtaaaaggtactctggtgaaaaggcctgctcagaagttgatagataccttgcaggagagcaaagcatttcatgtgtgacataaaattttcccgtttcgcctcttcaggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactcattctgtcttcagttacatttttaggggaggtaagagggtggtgatggtgaagtctggaaacatctctggtatagacacaacgaagtggatttattcattaataataaatatgaaaaaataataaattttaaaatttataacttgaactcaagaagagcatgaactttatgtgttcagatctttgccacacgtagagcaactctctgtatcatggtttcataaaatccaacatctaactaggtattcccataatgcaaaacttaagtatgcaaaaatccatcagaaacctattggtgttgctcttggaaataaaaggcaaaagtatggtctagaactacaaatagtatttttaaatataggtaatgcatgtgaatagcacagaattcaaatagttcaaaattgtgaaaagttaagtcttcctctctcctcttccatatcagaaaatattgactgtctcattcttctttatggctacaagatattaaattatagggatgtatcaaatttatttaaccagtccaacccactaccacattaaatatggttaaccaagctatctatatttaatggcttttctaagcaaacttttccttcaaagaataaacactttgaaattcaaaatgaggtataaatcttacccaaccattccacttctgagtatttttcttacagaggtaagtgcatatatgagaaatgagtacatacaaggatatttattgaaagagattggaaacaatccaaaagcccatcaataaaggccttgtataatatcacatgaccctgattttctgcttcacaagtcactgcttcatctttgtctttactcattctctacaaaactattaaaaattggattattcagtgctcagttcttttctcctcactttatacagccttctaggcattatcatgtactgtactctcaaggtttcatacacttttcacttccaactcacatctctaacccagacccttcctgtcagccccagacccagatctaactgcccatatgacatctccaccaggatacttcatattttcaacatattaaaaactgtacccttcgtttcagtctccctcgcacccatgtcttcctgcaccagcgtgccctatctctgtacctggtaccttcatccacccagtaacagtaaccagacacctggtattgatctttggtttctgcctctttcttatcctgaggcaaaaatcaatcaggaaatcatattgagtctgcctcctaaatatctctagagcctgtccaattctcactgtctccacggcaccatcctagtccaagccactatcacccttctccaagattatcgcagcagtctcctagctgccgtctatgccaccaattttgtcctccctcaatccattcctcttactgtggccagagtgatttgtctcagcatgttattttaaaatgttcaaatatacagaaaagttgaaactttatagtgaacactcttatatccaccacccaaattcagctctgccattcacatttgactatacttgcttaccattattgatctatctgtccatccccagagcaatctgtaaaaccctcatggcttcccattgtcttgagaataaaatataaattcctgctcatggccctgcacaagatggtcactgccagtttctcccagaccatgactcccctccccttctcttcagccacagaattcatttttctacttatcaattgtgccaggctctatcccacctcatggcctttgccaggagtcttcttggtccatcttttcttcagcttgattcccattagtcatccaggtctaaaatgttacctcctcagggaaaccctccctgatcactctctactgaactaggtcacggcagcctgcctctatttccccttcagtgcacacatcacaattataataaattattaacgtaatgagtccttgaatgtctgtgtctgtttcctccctgtcatgtccctagaatgtaagattcagaagggcagagacaatatttatattttttacagccataatcccagtccttagctcacagtaggtaatcaaaaaatatttgtggaacaagcaaaaacaaactaatgtaacatcatagaatattagactgtaggcatctttagaaaccaccatttctaactcccaattaacagataaggaaactggggcccacatagatcaagaaaaatgtctgaattcgtttactgattggtcttttaaaagccaccttgctatagtcaccatgctgtgcaatgacacagcataatgattatacttaaaaataatgtatatttcaaaacagctaaaagagaggatttcaaatgttctcatcacaaagaaatgataaatatttgaggtgatggatataccaattagcttggtttgctcattccacagtgtatatgtgtatcaaaacaccacattgtactccataaatatatacaattattatttatcaactaaaaataaaattaatttttataaaagcaaccttccaacaagtactgtagatacaaccctagactgctgggcccagcttgtctcagcatagatctaagcacaaagtatgcttccggccccgcatgtcagcttatcagaagaagaggccacagccttgcatggaacgtcctactccttctttgaagatctcaactctcatttttccctcagataaatcaagttgaaaagggacatggacaaatccaaaaggctgattttatccatgcatacataaataacacatacaggatgtggtagattaattctgttaatcagctctcctttcatttatgttgttattgtcgctggactcatcaggatgtagatttttcaggtcacgaaaacaccattaaaaaagatattttgaagtaacttcatactctcggcctctttttccttaagaaatgttcacaaatgtatagctaataatcattaagtacttaggtaattaatgaatgaattgagcccacctgattcagtcatattagtgtcatcactacctactactccaaggtttaactttttttttttgagaccgagcctcactctgttgcccaggctggagtgcagtggcatgatctcggctcactgcaagctccacctcccgggttcacaccattctcctgcctcagcctcccgagtagctgggactacaggcgcccaccaccacgaccggctaattaatttttttgtatttttagtagagacggggtttcaccgtgttagccaggatgatctcgatctcctgacctcgtgattcgcccgtctcggcctcccaaagtgctgggattacaggcatgagccaccgcgcccagcccaaggtttacctttggtgagggaggagaaagccatggaagtaattagagtaaaccccacctttagaagcaaagtgtaatgaaatatcaagtcctagaagcatctgaaagtgagaactagtggcattttgggctgtgatcaatgtttgtttttctcccatgtatacatttcacattaaagtgaacattgtctctagaagttaccagaagggttttactcctacgatagtgtcatgtatgacctctgaaattgtggaaaaataggaggggaatgttcatacaggcaaaagtacaacaaaaattagatttggaaaggtttgaacaatagccaggaaaattgcactgcatcaaggattccaaaggactatctgaatcatctggagaatgaattgaatacatttattccagagcattgctccaagcctactaaacaaaatctccagcaatcccaatcattttaatcaagcttcttgggtgaatctaatacaaatggatcagagtttgagaaacactgcattagaggacaaattatatcaactctattcttcaaaccaactctacatcatgatggcttcttgaatttgatcttgaaatagtcgatcttctgtatacccagagatcattaattgcaaggcaaccatgaaggggtggaaagagtctaaccttcaactcagagaatactagttcaagtcttgaattgggtacttaccaaccatgagacttcagtcaagttaattactctttataggccatggtctatttgcctgtaaaattggaataaataggctactttggagtaactgaagatatcaaataaggtaatatatgtaaatatgctttgcaaattctaatccattgttttaaaaaggtcattattggtgagctagttctattactctgtggttcataatttcttatgcccctcttttcctacatgctgggttaggtcttaagcattctatgtacaattaagtgatctccagtgtttaggtgtagcaaacattaaaaaacctgtattttatgctaggttaccccttgtgggtgatagtaatatatttattttagactgaaatttcacacttcattggattagataataaatattacagaaaatgtttaatatcatggggagaaaaattggtcagtttcttggtccacagattatggaacctgcaagcaaaccatctttcctcccctttcttcaacactctcttccagtgtaatgaccatcgctttctatggcccattccctataccctatgtcaggaagataaaacctgctagcctcacaataatgttgtgtagagtcatgttctttatgtacagaaggaaatttaccatgctgtcaaaacaatttccatagaaatgcaaactgctgttgtcgctatgagtaatcaattgtacctcatttacctcactagaatttatccaaattttctgggggagggtttcttttatacttggaaaactaaagtagaatatatggttagtattgcctataaatgccaaaacactcatatggggtagtagatcatacttttctctcaagtattttgacacaaataaagatttgtctctgatttcctttttctctgaaggagacagaaattaatacagcacataaatcagatattttattacagtaattgaagcaaaagtttaaataattggaattttctaaaagatgtcttcttataggagggcaaagaactagatagatatttaaatctaaatattttatttttacctctttttttctttctttttattattattattattatactttattgtgagatacatttactttggggaaggattctgatttctctttccaaacattttttctacttagtcaatagttcattttgtctttacaaacttgaagctcgtttgtgcaaatccacaggaatccataagtcccaataagtagacttatttttaaacctttctcctttggaaacaaggaaggaagccattccatcacaaagcagtcatggcaatcaattcaaggttgaacccgtagttgaaatgattggggattgggtatgtatatttgtttccatcctttcttagtatttattattcataaatggacattttaaaagagagatcattggctttcagttgatttgaagaaagagatatctggacttttccttagccttgatttttgagcttccccgccacctccattaatttgtcttccataatacctaaatatcttcttacattgtccctctggctgatggcatgcacaccagaatcttaagagatgtccttcatgcttttttccacatgggcttatggaaatattattcttcatttttagctctttcctgtcacctcagagcccagttctgttagagtcacttgcttgcaaggcatctgaatgcacagagccaggctgaggagtgggctgctggggagcttcccagggtgccaaattataaagggtgctaaacatccctgaaaatgtaatgaggtggagagctcctctcaggaagaatatggtattagcaggaagaaataatgtctgcttgaatagatagatggggtgaggagctcatgcatgaagagcaatttatggctgataaattgcctcctaagacagatctgtttaggtgtggggcctttgttttgctgaatggggcatgcaaccttggacaacacaggaattgggaaggacatagggaaaagggacatttgccttcactggggacttctttcaaatctcttccaccaggcaggcccacctaaaaatatatgttgtacaaattcttacagagcatctgagaattgcacgacataatcagcccaagtattggcccagctctttgaatgcaccaggtctccattcctggattgaacataatagtcatgaggagactttttctctgggacctgaagataagttcagaggtttagtgggctggagaaggaagacacattttcaatatctaagaacatctaaaatcactgggtcgctgaaacattggaatgggggctcttctttaaaaggaataagggataattttccaaactgtgccatagggtgggtcacctacatgtgagtatgttcatttctgctttgtcatggcattcacctgcttcagctgccaatttactctcctacactcttgttctgataggacgttggtctcttttctttgtttgtttttagttaatagagtttatttctcagagcagtttaggtttacagaaaagttgagcagaaagtataagagttcccacatactaccttccctctgagtttctcctattagtaacatattgcattgatgtggtacatttgttacaattgatgagccatattgatacattattattaactaaataccatactttacattaggattcattctttgtattttagttctatttgttttgacaaatttataatatcatatatgcacaattacattgtaacacagagtagtttcactgcccaaaacatctcctgtgatttaaaccatggcaaacactaatctttttactgtctccatagttttgccttttttcagaatatcatatagttagaattatgcaatgtgtaacctttttggatttgcttcttttacttttcaatatggcatttaagtttcctccatctcttgttgtggcttgatagttcatttcttttttattgtggtaagaagacttaatgtgaaatctactctcttaaattttaagtgtaaaatatagtatttttatttgtttttaaatagagaaaaagacagaagaactctgaggaaacagtaacaatttttttaattgtttatttttcttttatttatttatttatttatttatcctgctagatttttttgttattattggccacaaataactgttcctgtgtgcttgccttgccatatttactaactgcttgtcttaccatgctactaattgcaaaattagtagtaacacttaaatacttaacatgcctacttctaagcttctgtatgtaacatgcatcccagacaaaagctttgtgccaccctgaacttgctgcaaattgggattttttcattaaatttactttcctaatatctctaacatgttctgagttattcctgagttcttttttaacttttattttacattcaggggtacacgtgaaggtttgttatataggtaaattgcatgccacagggttggtgtacagattattttgtcatcccagtaataagcatagtatttgacacgtggttttcgatcctctctcttctcccaccctccaccctcaagtaggccctggtgtctgttgttcctttctttgtgtccatgtgcactcaatgtttagctctcatttataagtgagaacatatggtatttggttttcttattcctgggttcttgaagatggattatatgtcacctatccctcgtgtctttatatttatttgtctttggaggaaagcacatttgctgaattgacacacagattggatgggtgtctggttgctgtttttaaaaatagaatgatgttgaacaactcttcttggtgctcagctattgaatctgccttcccatttcggtttttgctcacttatcttcctgtaagtctaaactctgaaacaattactccctttgccctcccctcaataaatcaagggaagggatcagaaatgacatttattgagcatctactatgtgtcaagtactttatgaattgttacgtaatttaaggctgttttttaaaaagacctaagaggctcatagaggttaagtaacttgcccaagttcaaagatagtatgtaatacagcctcacccaacatggagcttcccagttcagatcccaaagcccaatttctttgcactacactaaactgcaacccaactagaaaccttgtgtttgtcatgagctggagacttgcctcttacagtgggattcatgaaccaacagcattaccaaaatctgggagcttgttggaaatgcacaatgtggggccccagcccacacccaccgaatcacaatgctcattataataagatccttagttgatttgcaagaataatgaactgtggaatgcattggtgtacagaaaatggcagaattgatattgacacttaagactatcgcctgtcagttgtagttgatgccaacattgtcctaagatccttccatttgccagtcttttctttgagtcctttttattccttgatttttttttctcggcatacacacatgcttgattactaacatctttgtgtgtgtgtgtgtgtgtgtgtgtgtgtgtgtgtgtgtgtgtgtgtgtgttttctcctgtggttatcctgatgacatccctcagccaggtaatttgactttatttcagagtccttgaaatgaaagacctaaatattttttattctagatgattctgataacctgctaaatagaatgaggaccaactgactttggacacagtctcccctaaacttgaggaaatagtccctgaaagctttattccatagtactaatcaaacatcttctagctggtatcttctattttcaatcaagactcaatatttgtgttgctgctgatgacgaactgtagagaaaagcatttggataccaagttggcttaagtcagtgataaatgtgaggcttaacccaaaagtacattttggttaacccaaacttgaaagaggatgatgtattataaagaacactgagttgatagttaagaaacctagctccttctccaagctgtgctacttgctgtggcttttgagcaagacaagttctctcactgaacctcagttttctcatctataaaatgggagacttgaactaagtgatattcaaagtctgctcaagctctaaagtcctatgacaacttacatgtgctagaattaatttactctttgacaccattgattgtaagaggcagccttactttacataccacaaaggaagaaacaaatgttgtcaattataattttttaagatgttgctctggatattctacatctgttcctgcatattttctctttgctcttttcacactgttttatgccctaagaggtgaaccttaatgatttgcttcaatgtgactctcttaccttctggattttggttgggtttggacaaagaaagccagcagtaggagattgaatggtgtgaggaaagtgagactggtatagttacaagcctggctccctcctgctgggtcaccaagtgatagtggctacctctattcagggctatagttctttttaggttaccttctcctgcagctagagccacagagccactcctgccctccaatctttcaggcctactagtggtaaaggctcctagctgttgctagtatcaccatcccttgttgttttcccttgaccctgactgcacctttataaataatccctctactaatctttcctcagtgttgcagccacagtttcagtgttccatctgtttcctgctgagaccctaattgatacagtaattgatattaggcttgttctttaggaagcagcctctcaaaatagaattccaagattgtattgctcacatatttgagaagcattcccagcacttggcacattaatatgtgcatagtacatgttaacgtctttgaataaaaaacaaaccaaaaaaatgtcttccaatcgtagtgcctctgttcactggaagaaatataaggtagccaaaaatcaagacagtttttcttatcacttttatttctaagatattatttagtctaggctcagagtctataactcaccaatcctttagcaaaactgctaatcagaattgcgtgggctctcgactagtaatgactgagactactcagtctggaataaaagctactgtgcctttgaaaaactccattgcattttctttcctaatttctaatttactaattggtctctatagagacaaaggaacaagtgtctcacctctggccctcctctagggaaatgctactcaaggtgctggcccatgataagatagggagcttgcatcagaatgtaaatcagtgtgtggcttccttcatggaaagttttgcaatcaaaaacatcagctgaactaaataacaaatttattgacactgttgatttccagtcttgggcaaactccttatctccttgtaaaccagtaataaatggtgcagggaccagcaactagtacaaggaccacattctgaggagcattgctctagagggtcttggaactcagtcccttcacaaagttcatatatttgtgctatattgctgccacttgttgagaaataaaagtatttcttctctttctggtttttcaagagagagagaagtaactcctcttttgaagcctggaagttcatgcttagtctcagaaggcatcagaaatccacttatcctgcccaagagtcaaacgtaatttcatgaaactaagcgacacattggaaggtactcaagagagaaagattcagatttgatctgtgaccaaacaatggcatttcagttccatttgaagtcaatttgttagtctcacagcactgctgcctaagcacagcaccatccttcacagaaacttgttctgatgtagagagagacaatacaacatttcaaacacgatgcagagaaattaaattttcttcaagctccaatgcagccatagagcaaacagaaaaacaaatccttaagctgttgagcatcttcagaaatgacaccatagtaacagaaatgcatctgtaccctgcacattcattagtaaaattgattctgatgaacaaagctaggtgctttgcaacattcctgtggctttgtcctaaggagaaacaagtgccatattttaaatgagttaaacataagtttaactttgtaatgcaaacactaaaaaccttggccaaaggcagagaagcaataacaagtgtttctccaaagggggaggtgtattcccatcattggttataactgccatctttctcacctcgaccaaaacggtggttctcacccttggcttcacatgagaatccccttggaagcttttaaaatccctcaagtcctgtctgcacctagaccagttatatcgtaatctctgggtgtggcaccaaatcatcagtattttttaaagctccccgagtaatttgaatgcatatccaaggttaaggcataaagtgtattgagagggctggtaggccaaggttgtcgtgcttgcagtcttgctgacaaagacatcccccttactgcagcaacccttaggacacagctatacaagaagccctcagtgtcccttcttcagttactgtaagtcccagctttaaagctgttaacaagcaagtaaagctgagaggagatgaaatatttgtgacttcttgtgaagattaaatgagatcatttgaacgcagtgttacagtttagatttttttaaatttaattttaagctcttggatacatgtgcagcatgtgcaggtttgttacataggtaaacgtgtgccatgatggtttgctgcacctatcaacccgtcacctaggtattaagccccgcatgcattagctattatcctgatgctctccctccctcacagtttagagtcttgatgaaccaaaagggtctgctcatccctgctcttcatttctgattaatttagctaaggatacagaacctaccaaaagaaagatagctgcaaagaacaggagcagatgcagcacatgtggagaaatgttcccttaagtgtggggtctctacaaggcacacagctattaggaacagtccccacaagacctaccagagttaagaaagatgccaaattttgggttttttccactcctttctattccagattccatcacaattccagaattatattaacaaacggggcttttcagtttaaggcagtacaatgtttggtctttggactcctgggtgtcctaaaacttcttcaaggggttagcaaggacaaaactatcttccttacttgctcttttcactgtgcaaaactgtagcactatggcaggaatcaaggcagtgcatatttttatcttcatgctttcatagtaagaaaagtaaaataccagttttatttaagaatatccctgatgaagcagtaaaaaatagtcttattaaatcttgaccctaaatacatatgttttaaatattttctgtgcataccaaagtatgatgcattttcagcattctttttattttaaagaacaaataacgggttattcaagcttgagaatttggcagacattttttcaaaaacgaacaaagtgagcctgtcacttcagggaaaacaattggcagtacttgttgccaatgataacattaaagctttgaagcaaaaattagaatttttgaaaacttgtatctaccattgtgactgtgacagcttcctaatacttatacacttttctgataagattggtgatgacattaactaatgtgatattctaatattgtgtaacaaaatttatcaatctttggaagagctacttgattcagtgaaccagtgttttctaaatgatggatgcatgagttacaaaattgtgcatagataaaagatacattcaaagcacaagatagaccagtggattttaatgcaacagagtacaaagagttttcatatcaccattaatctttaaggaactaccacttgttgacttttggtgaagtgtcaaaaaaatattcacagttatctaaataggctattaaaatactcctcccttttccaaatacatatatgtgcgtgtgtgtatatatgtgtgtgtgtgtgtgtgtgtgtgtgtatctgtgaagccagattttcttcttatatttcaatcaaaataacatattgcaagagactgaataggaaagcatatatgagaaactagctatcttctattatgccagacttgaagagacttgcaaaaatgtaaaataatgctgctcatcttactttttggttttgcaaaacatacttagattttctcaaaaatatgttatctacatcatcatgcaataaatttattttttgaaatgcatcgaaatataatttttaaaatttctctgttttgatttctaacctggtaaatattgagagatgtaactcacacaaagaaaagtactttggaatccttcaaaggtttgagaactgctggtttaaggaaatttttatagacctaggctgttcacatttttgtttttgcagacagttaaattactaattcacccagcttggtgttgtggaagcttgattttaggctttgttaaggaggtctactttgatttaactgaatcctgaatcttgttctttacttttgaagagtagtcctgaattttcagtggaagctcaacctgttcactgagctcctttaacttgaaaggatttgacctccaaactatctctccagcacagatcagctgctgagatcactgctcagctcaggtctttcccttcagctattttgttttcctcctggacttctcgtagcctcactctgtgcatgcacagctcaggggtcagttaaagatttaagggcaatttatatgcacatttgggttccccctcccaaatcccacccactggctttctcctttcacatatctcctccatttccacactctctggtcatcctgccgtcatcctctgaatcctcagcccagtaagagtacagccttctgcttgagttccacatccagtacactagcaaatggaaaagtcctcaagggaaaagccaaccaaatgtgcatgttacccaatgtgcttacattctttcaaggtcatagttatttcagactctgcctgcttttggttgagtgccaatgagttccagtaacttctctttctttattttgtccaaagttataattgttatcagcagggaggttagtatgatatggggtagtctgccattaaatgaaatttaattcctgtgtcttcccattttgaactaagattagcaaggccaagttctcatctgtggggtgacagcagagccataccagacccttgaacaatatatcctccttcatctgtgcagtgttctataaaatctatttccccacaatccactcagcaagtctggtttaatatcctcttgccggggtggttctgatgttgggccaaaggccatcataacatatccaattgtctcacaatctttttttttttttttttagacagggtctcattctgtcacccaagctggaatgcagtgtcgtggtcacagctcattgcagcctcagcctcccaggctcgagtgatcctctcacctcagccttccaagtatctgggaccacaggtgtatgcctccacacccagataatttgtaaacattttttatagagacagagtcctgctatgttggcccaggctggtcttgatttcctgggctcaagcaatcctctcaccttgacctccgaaagtgctgtgattacaggtgtgagccaccacacctggccaattgtcttacaatctaataaaatcagtgtgttgaagacatatctgcactcccatgtttattgtggcattattcacaatagccaagataaggaatcaaactaagagtccatcaaaagatgaaagaatatttttaaaaatattacctcggttacctctgaaaatattcttgccttttgacaacagcagcaggctctttttgaatttccctgcccacacgtagagccaaatactctctaggaagtcctgtctccttgtggagttgatgatgattcctgtgtaacctgtgctagatacctcaaggcaggaagaaccaggcccagcctccaccataaggtcagttctggtcatggtagggggctggacctgactcttcctgtctcggttgtctaagataggttacacaggaatcacaaggaatgtcagttctggcactaaaacattgtcctctgaaaatggaaacctcaaagcctatcaagttcatccatgtctctgatgtctataatcctccagttacaggcatgagctgtctccctcactggtcttgttgttgtctcattctcatactgctctgagtgtccccttgcccaactctcttccagactttgatgcctctggactattgccgtacacacacacacacacacacacacacacacacacacacacacacatttcatagtaaagtgaccttttgccttagtccacttgtgttgctataaaggaatagctgaggctgggtaatttataaagaaaagaggtttacgtttacttggttcatggttctgcaggctgtacaagaagcatagagccagcatctgcttctgatgagggcctcatactgcttccacttgtggaggaaggtgaaggggacctggtatgtacagagaacacatggcaagacaggaaacaagggagaggggagtgcagttggaggctctttttgatgaccagttctcaggagaattctcacaggaactaacagaggaacaactcactccttactgccaggatggcaccaagccattcaggagggatgtgtccctatgacccaaacatctcgcattagaccccactttcaacactgggaatcaaatttcaacatgagacttagaggagtcatatatccaaaccatagcaccttcctatagctttagtatcttttcaaaatattcttgagtaaattcttgttttcctctttgtcgcttttcttacagcaggttgctctttcatactttaatatcacttggttgagaggtaatgtcaacatctgctcaattccccacagctccttcttaattgatcattctttcctaatctgagcaaaagaccttctctgagaatcctgccatctaccatatcactttccatcatgctctccttacagtcacctatctatacacagttatctcctccactctatatatccttggaatttgactctcactcatctcctttgccttaactcctgccagtatccacatcacccatttggataatttattcaacttcctaacatcacaatttcaatgatattttcttcatctcttccaaatctctcatatctttatactgattatattcactcttaaaccacattaggatcattagcctttccctatattctttgaataggtcagtgccactactgttttttgtttttgtttttgagatggagtctcgctctgtcgcccaggctggagtgcagtgccgcgatcttggctcactgcaagctccacctcccgggttcacgccattctcctgcctcagcctcccgagtttctttttggactaactcttgtccttgtgtgtaatcacacaatccattttctcaatactacaaccaactccctccccttgtcctgccaccatacctttgtcacaaccatctacccccagattagtctttcagtatgccttctctcttcctcaacctgtgtgactaagcattgctgaagaaaaatggtcaattgtactgaatgattttatcatggcttataagatatgtcttcaagagatgcttgatatcactgttaactgtggaattgcaaggaagagaagtccaagaaatccagtgtttcaagactacgcttttaattttactgtctgtatcattaaggacttaattacagagaatagagtcaacgcaagctagttcaaagagaaaggatattgttcttatctagagtggaaggttaaaaaaatagactttatgctgaccttccataaaaaagtccctaaaccacctgggactgccaagggaactgctaagaagttgtaaaattgggaattttcctaccaatttgggaagccacaattatatttgtttattctagaactactccatgttttctaccataaagaagccatgtccctcattattaaaacgtcaaaaaaataaaagatgttggcgaggatgtggagagaagggaatccttatacattgttggtggaattgtaaattaatccaacctgtatggaaaacaatatagagatttctcaaagaactaaaaatagaactaccatttgatccagcaatcccacccctgtgtatatacccaaaggaaaagaaatcattatacaaaaagacacttgcacttgtatgtttacagctgcactattcacaagagcaaagctatggaatcaatctaagtgtgcatcaagagatgattggatagagaaaatgtgatacacacacacacacacacacacacacaatggaatactactcagccataacaaaaagaatgaaatcatgtcctttgcaacaacatggatggaactggaggccattaagtaaactaactcagaaactgaaagtcaaatactatatgttctcacttataagtggaagctaaataatgtgtacacatggacatagagtgtggagtaataatagagtttcagaagggtaagggtgggtggggatgagaaatgagaaattacttaatgggtataatgtgtacactatttgggtgataatgataccaaaagcctagacttcaccactatgcaacatatccatgtcacaaaattgcacttgtaccctctaaatttatgccaataaataaataaattgccatgtccccagttaagaagttgtcagcagctatgggaactggcagaagctagccttcaaaataggccccagtgatctttacctcttagtatccatcctattgtgttgtcctcttccccattgaatagggctgatctgttggaccaacaggatactgtggaagtaacagtgtgtgccttttgagactatgtcataaaagatattgcctcttccactttgccctttcttggatcacttctaccagaggaagccaactaccatgttatgagaacattcatgcaacactctgtggagaaatccatgtggagacaaatagagatctcttccaaccatcagcaccaacttgccagtcatgtgagtgagccactgtggaagcggattctccagccccagtcaatcctttgactgcagtcccagccaagatatgacagcaatctcaagagagactccaagccagaattggccagctaagttgctcccaaatccctgacccacagaaattgtgagagataatatgtttgttgttttaagacactgatttttggggtaatttttactgcaggaatagtataggtatcaacatcctgagcattaatccttgcttcaatgtgcactgcctttcctctccttcactgctcactccaatgatctaagctcaagagttgagagtttgtagaggtaaatctgcagttctctgtgaatggactggactcttccaccttctagttcatccttcactactagatttctaataatggtttctattggactaacctcccacagacaacaactatatctggatatatatacatatatatatatacatacacacatatatatatacatatatatatatacacacacacatatatatacacatatatatgtatatatatgtgtgtgtgtgtgtgtgtgtgtgtgtatactacaacctgcatacatgtgtagaagttctgcagtaccaaattgtaagcaagcagaattaggaactgtttttttttttttgtttgtttgtttttattaggtccaaaaggtacatagaaaagttctgcaagatttccagtgggaaaccggttctctagagagaggctattaattaatctttagaaatgtccccaaattttgatgcagggtatttacttttaaaataccatagtggattcattgatcttcaaatagtctgttgatcttgttgggaaaagtgcttgcaatattccaagtcatcaggtaaattggtttgaaggaatccaagtagttccttaaatgtcagctcatcttcaaggtttgaacctttcagggtatggggcaaagggcacaggctgacttgtcaaagcaagagagctttaacaaaggtagaggcagatatatgcttgcttaattgtaacaaatgatctcctgaacttttccttttttcttttatttccataagtttttggagaacaggtggctatttggttacatgagtaagttctttggtggtgatttgtgagattttggtgcacccatcacctgagcagtgtacactgaacccaatttgtagtcttttatccttcaccctcttcccacccctattgaacttttcatggtttccagttggtcactatttgacattcctctatgagccatgccattgacctttctgatacatctgaagaagacagaagtcaaaaactggcttctagtatgctctgtgaacaaaatcatgtttgtaaatagagtgtaaacctattggcagttcagcaatcgccctgcctaatattaaaaaaaaatgttaaatctgctttctgtgttaaatctctgtatgttagaatttatctattgtttctataaggtccaaaaggtgcacagaaaagttctgcaagattttcagtgggaaaccagtgggaaacatcattcacttagtcattttatttaggaatagattgtgaaccaaactgatattctaaaaatggaggaaaaatttcaagatttgcatgggagaattgaggagtctggctactggttaaaaaccaatgtgtgatttttcaggcctgatcataggcgatgacgaagactttacctggcaggcttcactgggaaagctgccctccacacaccagacttggtgcacagccagcgtatggcagtctctgtggggtgttgcagtcaaagactcagaccccctggccaatcatgctctttcacatatttacattcctagccctgtgccttcatttctaggccctttatctgaggccttgggcaagaggtcttcaggttcctctgctgagatcttatggggtaaggaaaagggaaaaaatttgaagatactttccttcactctgcctcagtgcccaggacttttccactcctaccccaccacatgactccagggtccgtaaaactgccagagccttttgttcgggactccctcaatataaagatgaccccacgtctgtgctgctccacttgaatcttgaccagcgtgctgtcccacaggggaaaatggaagagtgaagttgatgcttcctctggttttagactgtgactgaaggcttaactctttcattttcagcttgtggctttaattggctacttgaacacctgacagctcagctctctcccagctcagcagagctcctaaa

SEQ ID NO: 828 - DNA, 46957 bp, Homo sapiens
aagatgtgaaactcttaaatatacatggcaaattgattccacttatgacggataagaggtaatacatttagtattattgaaaatatacagcctgggcaacatggcaaaacccgtctccacaaaaaaatacaaaaaattagctgggcatggtggcgcacacctatagtcccagctacttaggaggctgaggcaagaggactgcttgagcccaggaggtcaaggttgcagtgagccatgtacacaacactacactctagcctgggtgacaaagtaagaccctgtctcaaaaaaaaaatacacacatgtgcacacatgcacacatatacacacatacacacacatgccttactacctattccacttgtagttcataccatagggaaattatggcaaattttaacatgtacaagaatgacaacaaaattttagaaaccaccaaatatccaccaataaaggtatggaaagtgaactatgacactcatatttccgctagcacagcagttaaaataaatgatctaaatctaaagtatcagcataaagctcaaaaggtaatactgaacacagaaagcaagttgcagaaagatccctataattttttttttttttgagatggagtctcgctgttgtcacccaggctggagtacagtagcgtgatcttggctcactgcaacctctgcctcctgggttcaagcaattctcctgcctcagccccctgagtagctgggattacaggcacctgctaccacgcctggctaatttttgtatttttagtagagacgggatttcaccatgttggccaggctggtctcaaacacctgacctcatgcgatccacccgcctcggccccgcaaagtgctgggattacaggcgtgagctaccgtgcctggccaagattcctataatttgagtgtaacaatctggtaattttacaaaaagaattctgtattgattacaggtacaaatatatgtagcaaaagtataaaaacatagtttagaaggatactcacaaaattcatgatactgtttacctggggaggagataagaggaataggcctcaggaggggaaaaatgggacttcaactttatttgtaaacctctgtttcttttcttttctttttatttttttaattttatttatttatttatttattttgagatggagtctccctctgtcgcccaggctggagtgcagtggtgggatctcggctcactgcaacctccgcctcccgagttcaagagattctcctacctcagcctcctgagtagctgggattacaggtgcacaccaccacacctggctaatttttgtatttttagtagagacggggtttcaccgttttggtcaggcttgtcttgaactcctgaccttgtgatatgaccgcctcggcctcccaaagtgctgggattacaggcgtgagccaccgtgcctggcctgtttcttttatttttaaaaaaatgacaaaatgttaatatttgctaatactgggaaggaagtacaagagtgtttgttaaaattatgattttctgtacttttttgcagttttaaaagaaaggcttttaggctggacttctgaaatgacagagtgagaggaaggacctcagtaaatcctcttcccccaaaaagtaatgaaaatactggcaaaatcaaaaattatcaaaatcaatcatttcacgactttagaaattaaccaaaggcaaacaatcaattaaaaatcatttattcaagaaaaactatgccagacgtggtgactcatgcctataatcccagcgctttggggggccgaggcggatgtatcacctgaggtcaggagttcaggaccagcctggccaacatggtgaaaccctgtctctactaaaaatacaaaaattagcaaggcatgatgacaggcgcctataatccgagctacttaggaggctgaggcaggaaaaccgcttgaacctgggacacagaggttgtagtgagccaagattgtgccattgcactctagcctgggctaaaagagcaaaactctgtcacacacacacacacacacacacacacgaaaaaaaaaactagtaaacctcactaagaacagccaggtcatggttcacttggcactactactactcttcctgctctcccactggctccccagctccatgaaaactggtagcctcacagctacccaaggggatgaactgttttggagctctaccaaaagccctatccccagacagctgttgctatttgatctaacttaaagctcagctccaagaaaataaaggacactctatggtaactcaaatccacacaaagaaataaagagcaccagtaaaggtaacctgtaggaaagtgttaacacagcagaactgatctttagaaggacctgctcacagggctggctcctggctaaagtctgggaacttggcttgtgaaatattccctatgttgatatgatggttttgcctgcctagggcactgaacacctgtttttcttctgggagtctggatgcccgaacactagaggctgatgattttctggtatgatgtgcctatttttagtgggtcaaactggacttgcccacagacaaagtgaaaggagcttaacaaaaaaggcctagcttgccacttggatgtgcagtgcagctgtctggccctgtagcatcttggctttgcatgggaaaaaaaaaaaaaaaactatccctgtggggatttatttcctatcaggcacccagaactactggtggcagtgatcccatatggggatatgtcagagcacctgagataaagggggtaaaatcttataagctgaaacagagaaaaaaattatatcaagtatcaataatcagaatagctttacactgaaaattagatgacaatggagcaatgccttcaaaagtctaagggaaagacatttccatcctagaactctacttcaagccaaactctccattaggagtcaaacacttgtagacatccaaaaatctcaaaacttcatctcccatggacctacatcctttcttacgaaagtacttgaagactgtgctccaaccaatgaggaagggggcatggcataaagaaaatatggaacccagcaatgcagagggtgaagggaatccccagagtgacactgaagagcaatgtcaggatggtagctgtacaagaaggaatgagggtaatccacccagatgagagcaggtcagaaggctctagaaaaactcagggatatgacactgaggaaacccttgatatctccagaagcgctcagagtcactctagacaactggtgataagtatatggagaaagaaacaaatgaaagaaacaaaacaagccaggagaagtggttcactcctgtaatcccagcactttgggaggctgaggcaagagaatgacttgagtccaggagtttgagaccagcctagactctcagtccagtgagaccccgtctctatgaaaaacttaaaaaattagctgagtgtggtagtgcacagctatagtcccagctactcgggagcctgaggtgggaagatcgcttgagcccaggagtttgtagctgcaggctgcagtaagccaagaccataccactgcactccagcctgggcaacacagcaagattctgtctcaaaaaaaataattattaaccaaaggaacacagttatgcagggaaggtaaattaatcatagattactatgtggcttggctgtgtatagtatttatatatacagttagccctctgtatccatgggttttacgtctgtggattcaaccaaccaaggatcaaaacccacaaatacggagggccaattataccatgccattttatatcagggatttgagtatcaatggattctggtatccatggaggttctggaacaaatcccttgcagatacagagagctaactgtatagtcatattgtaaaaaatagtactgatggaaaacaaatttatggtataatcacattgggactattgggaaacaagaagtctatgtacatacgcatgcctttgggtgggtgacaggagcagcgtggtgagttcaatcttaaccttccacagtgaaacatttcaaataagttttgtaaaatatatgtaagttataaagaatagtaataccaaaaataatacctgggtatccaccacccattaaaactaattatagttatctttgaagttcttcatatgcccgtttcattttctttcttttcagataatcaatatcctaaattttatgtttatcatgcccttcactttctttacagtttcaccacatttattttattctttaaacctcaggcatgacctacgttaataaaactaagagtttttttttttaaatcaagagaatactgccttaggttggtaaatcggacatctcagatgaaacataatggtctagaaaaatgaccagaattgacagaaaatacaagaagcttgaataattcaataattgtttttttaaatgataaaaactgactccataatcaagtcttgccatatccagatggttttgaaaatgactagtatcaaactctcatgaaactaaatttcagtcacagtttcaaaaattacaagaaggaaaagtactcagtttattttatgcagctagtataaccttggataccagaataagagaagaaagtacaaaaaaagaaaatctaagatctattttacttctaaacattaatgcaaaattcataggttaaatactagtaaaatcaattctaaattaattttttaaagtagtttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatctcattgagcagtggtttgtagttctccttgaagaggtccttcacgtcccttgtaagttggattcctaggtattttattctctttgaagcaattgtgaatgggagttcactcgtgatttggttctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttaccaaaacagagatatagatcaatggaacagaacagagccctcagaaataatgccgcatatcgacaactatctgatctttgacaaacctgagaaaaacaagcaatggggaaaggattccctatttaataaatggtgctgggaaaactgcctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggaaacctacaaaatgggagaacattttcgcaacctacccatctgacaaagggctaatatccagaatctacaatgaattcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacagatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcgtcattattcacaatagcaaagacttggaaccaacgcaaatgtccaacaacgatagactggattaagaaaatgtggcacatatacaccatggaatactatgcagccataaaaaacgatgagttcatgtcctttgtagggacatggatgaaactggaaatcatcattgtcagtaaactatcacaagaacaaaaaaccaaacaccgcatgttctcactcataggtgggaattgaacaatgagaacacatggacacaggaaggggaacatcacactctggggactgttgtggggtggggggaggggggagggatagcattgggagatatacctaatgctaaatgacgagttgatgggtgcagcacaccagcatggcacatgtatacatatgtaactaacctgcacattgtgcacatgtaccctaaaacttaaagtataataattaaaaaataataaatttattaattttttaaaatgcttcacaattaagtagagtttagcacaggaacacaagaacacttcaatatcagaaatttattcacgtaatctaccacattaatagattaaaggaggaaaaactgtcttctcaacatatgcagaaaataagcattcaagaaaatacaacactcattagtgattttttaaaaagtcttattaggccgggtgtggtggctcacgcctgtaatcccagcattttgggaggccgaagtgggtggatcacctgaggccaggagttcaagaccagcctggccaacacggtgaaaccccatctctactaaaaaatataaaaaattagccaggcatggtggtggatgcctataatcccagatacttgggaggctgaggcaggagaattgcttgaacccaggaggcggaggttgcagtgagccgagatcgtgccattgcactccagcccgggtaacagagcgagactctgtctcaaaacaaaaacaaaaacaaaacaaaacaaaagtcttattaacaaaataggactaataaaaggggctcttgatgaaagatatctttcaaaataccacagcagatatcatatttaatagtgaaagctatagaagttacatcatttctgtgcctcagtttttttcatatataaaacagggataacaaccagcctactttacagggtcattgggaggattcaactatttaatatgtgcaaagcatacagaacaatgcatttgtggcacatggcaagcattcaaatgctgcttattattttattacaatcattgtcttcatgattatttccactaaaatcagaaacaaagaatgcaatatcattgtatctattaaacattgtactacaggtcctaattcattgagagaagaaaaagaaataaaatgtataattggaaaagacaattgcctttataaagataattattcacatagaagaccgaagagaattaaaaaagattagtattaataaaagccttcagaaagatttctgtacacatgattttatgaatatcactagcattctcatatactaatattaaccaattagaagatgtgataggaaagaagatcccaatcacaaatgcaacaataactcagaggtatctaggaagaaattcaacaaaaaatgcacaagatcttcctgagaaaaaatttgaaacattattaaatgacataaaaggataactgagtaagagttcactgaaaggaaaattcaatagtataaagatgccaattcccaacccactcccaactcatttctaaacacatgcaattgcaattggaatcccagagttttccttggaactcaacaaacgaatcctaaaattcctatgggagaccaaaggatcaaaagagataaggggactaaagcctattagctcttaacagcattaattgataagaatggtacaacaggccgggcgcaatggctcatgcctataatcccagcactttgggaggccgaggcaggtggatcacctgaggtcggagttcaagaccggcctagccaagatggcgaaaccctgtctctactaaaaatacaaaaatttgctgggcagggtggtatgtgcctgtaatcccagctactcaggaggctgagacaggagaattggttgaacccaagaggtggaggctgcaataagccaagataacaccattgcactccagcctgggcaacaagagtgaaactccatctcaaaaaaaaaaaaaaagggtgcttgcctgggcacagcagagcaactgggttttggccgggcgccacagtggctcacgcctgtaatcccagcactttgggaggccgaggcgggaggatcacctgaggttaggtgtttgagaccagcctggccaacaaggtgaaaccccatctctactaaaaatacacaaaattagccggccgtggtggcacatgcctgtaatcccagctacgcaggaggctgaggcaggagaatcatctgaacctgggaggtggcagttgcggtgagccgagatcacgccattgcactccagcctgggtctctaaataaataagtacataaattccaggcaggttttaagaaaataaacagcaaatatttaaatttttaaaaaattatataaaaatatttttatgtgctcagccccccaaaaaaaatacttaaaattacacaaaaagggtcgggcatggtggctcatgcctgtaatcccagcactttgggaggccgaggcaggaggataacctgaggtcaggagttcgagttcagcctggccaacatggtgaaaccccatctctaacaaaaatataaaaaaaattagttgggcatggtggcacatgcctgtagtcccagctactcaggaggctgaggcaagagaatcacttgaacccgggaggcagaggttgcagtgagccgagatggcaccactgcactccagcctgggtgacagagtgagactccatctcacaaaaaaaaaaaaaattacacaaaaagcaaactaaaaattgatacatttgattattttacaattaaaacttctactcaaaaagacaccataaacaacctagactaaggaaagatattgactatacacaaaattgaaatctagaatatacaaagaattcatataaagcaataagaagagacaaactcaacaaaaacatgaataaagaatatgaacaggtggctgggcacagtggctcatgtctgtaatcccagcactttgggaggccgaggcaggcagatcacgaggtcaagagatcgagaccatcctggccaacatggcgaaactctgtctctactaaaaatacaaaaattagctgggcgtggtggcacacacctgtagtctcagctactcaggaggctgaggcaggagaatcacttgaacccgggaggcagaggttgcagtgatctgacatcgcgccactgcactccagcctggcaacgagtgagactacgtctcaaaaaaaaaacaaaaacaaaaacaaaaaaagaatatgaacaggtaagccacagaagaggaaatctaactagtcaataacatatgaaatgataaatactttcaatagtaatcagggaagtgaaaattacaataatataccaatttacccttgccatattaccaaaattcaaaatctataattctgtgtgtgtgtgtacacgagtctaaatcacacactatctgtaacattaattttgccacataaggtcatagagctttgcattttaacattgatgattcctattcaaaagctgaattccatacatttcacgaagctgtatctgcccacctggctgcaatccatgcttttaggggattaatttgacatgatgttaaaaccagctctttttatttcaaagactggtaataaaatactatcaagtattttcccagtccgcaggcctttacgggactcaaaaggaataggtcaaaaccacttaatgtcctttatctctaacataccctttaaaagcataagagtgttggccgggtgtggtggctcacatctgtcatcccagcactttgggaagtggaggcaggcagatcacttgagtccaggagttcaagagcagcctgggcaatatggcaaaaccctgtctctaccaaacaaacaaacttagccaggtgtcgtggcatgtgcctgtagtctcagctattctgaaggctgaggcagaaggatcaattgggcccaggaggttgaggctgcaatgagccaagatggcgccattgctctccagcctaggcaacagagagagaccctctctcaaaaaattttaaaaagaagaaaaacaaagtataagagtgttaaggttaaagacgctaaggaaaataatttctttagagatagccattggaaagctgcggcattttctctctccaataggtgagtgaggagtgtgttcaccccaccccaatctgatgagaaggatttcaaagagatgacctgttcgatgtacatccactagactttaggggacacagagaacttggcacctgtctttcatgtagaaaaactataaatgacaggctgaggcagtctgtggtagtagagaagaggttgcgtgggggtgaactgtgggtcttactcccacaatcacacacactccacaagccagatgtggaccctctggacatgaacaggctgggttactttagaaagagggctttttgctagcatcaaggtgacctcagcaaaaggagactgaaggtacaccatggggcccggggatatattaaataactggttgggaaagtggcccttcctgcatcaaggaaattgcagtcaggggactccagctaggacatctccaaggaaaccataaagtgtcaagaacaggaagaatcagtctttggaatctgcaacatagagagggcatcagtattagattacaactttgttagttaggtcaaactttttttgcccattgtatctccttccttccttcctcacccactacactcaagggccagagatggcctaggtgttgagtgggggagaaagggaagggagaagagctagctggaagagtaaagaaagaaaacactgagcatgttctttttgccactaaaatctttcagcctgaagcaggtatttgctgggagagagcttttcctttaaatgaactttattgttttcaatactatatgtgattagacttactttaaaactaaaataagactaccactgaccctcagaaattgaaaggataagggaatattaagaacaactttatactaataaatttgacagacgaaactgataaactccttgaaagacacaaattattggctaggcgtgatggtgcatgcgtataatcccaacactctgggaggcctaagtgggcggatcacatgaggtcacgagttcaagactagcctggccaacatggcaaaaccccatctctactaaaaatacaaaaattagccaggcatggtggtgtacgcctgtaatcccagctactcgggaggctgagacacgagaatcacttgaacctgggaggcagagattgcagtgagctgagttggtgccattgcatcctagcctgggtgacagagcgagactctctcaaaaaaaaaaaaaaaaggagaaaagaaagacacaaattatgaaagctcattcaacaagaaatagatcatctgaataacccagtatctatcaaacttttaaggaagaaagaatacaattctacataaactcttccaaagaattggaaagaggagggaatacttcccagcttgttctgtgatcttattatcttgattgtggtgatgtgatcctgggtatatacatgtcaacacttaccaaactgtttgctttattttttattttttggagacagggtcttgctctatcacccaggctagagtagaacaatcatagctcactgtaacctcaaactcctaggctcaagtgatcctcccaccttagcttcctgagtagctacgactacaggcatgtgccaccatgcccagctaatgttttttatttttggtagagatggggtcttgctatgttgcttaggctggtcttgaacttctggtctcaagcaatcccccccacctcagcctccccaagtgctagaattacaggtgttagccactgtgcccatccctgtttaagtacgtataatttcttgtatgccaaattaaaccacagtaaagggtttaaaatagctaaatcagtacttagagatagttatggcattcacaatgcttatattagaaaagaagggtctcaaatgatgacctaagcatccaccttatgaaactagaaaaagagcaaattaaattcaaactagcagaaagacagaaataaaaaagataaaagcaagaatgaatgaaatcgaggtttccatttctagccacaatagagtaagtctactacagcctctcctactgattattgcaacaaaaatctctgaacaaaatacataaagtaactacccgaggactctgacaagtcaacaaaaccaggaagactacggaggtgagccaaaaagtagagaagcaactcatacatcagtgggttccccttttatccctcatattctctctcaagactctgacccaaatacaggtcccagtgacttatgaacatacagaagtcctgagttcatccaggaactcttcactcaagagaaagcaaagctacataccaagccttgagaactgaactaagatttaagccacagctcaagtctgagactaacacctgagtgacaaatgtaagcagggcagtgaaggctttgaacactgcacaaagactgaacccaccactcgagtctctaatccctaaatggcacatgcacacgacagatcaaaaggctttgaaaactgaactggttggaactgacacccatagaaggtgagacagacctagtggtttattacctgataaagatgaaaagcaataatggactgggcgcggtggctcttgcctgtaatcccagcactttgggaggccaaggcgggtggatcacttgaggtcaggagttcaggaccaacctggccaacatggcgaaacccgtctctactaaaaacacaaaaaattagccgggcatggtggcaggcacctgtaatcttagctactcgggagactgaggcaggagaattgcttgaacctgggaggcagaggttacagattgcagtgagctgagattgtgccactgcactccagcctgggcaacagagtgaaactctgtctcaaaaaaaaaaaaagaaaaagaaaaaagaaaagcaataacgacacagtccaccactatccaggatggaatccaaaattattcaacataaaaaccaatcacaaagatgtgaccaattctccagggaaaaagacaataacagatgccaatcctgaaataacctaggtgctggaaatatcaaagacatttaagtagttatgacatctaagctccatgaggtaatggcaaacacctgaaatgaatggataaatagaagttctcaacagagaaacagaaactgtaaaaataaaaaaattataaaaatgattggaaaaaaaaacagggtctctggggacctgcaggacaataccaaaaggtccaatgttcatgttattagagtcctcaaagaaggagaagaagagactactgtagaaaaaaaattgcaaaaaataataaccaaaaacttcccatatttggaaaaagacatatatttacagactcaagaagcacagcacaccagaatcaatataaactcaaaagaaacaccagaaacattataatcgaaagcctggaaagccaacttaaaacatttctaatgcagccagaggaaaaaaaggtacactgcctacaaggaaacaaggattcaaggactgcaaaattctcatcagaaacagtggaggtcagaaaacaatggaacatcttaaaaatactaaaggaaaagaaatatcaatccataattctacatccagcaaaaacacccttcaagaatgaagacaagtgctcactgtctaaaattggaacatatactaaaattggaacaatacagagaagattagcatggctcctgtgtaaggatgacgtgcaaatttgtcaagggtttcattttttttataacacaaaggataaatgcttgaggggatggataccccattcactctgatatgattattacacatcatatgcctgtatcaaaatatctgatgtaccccataaacatatatacctactatttacccataaaaataaaaattaaaaaaaaaagaagacgaaatgtaaaaattatcaggtaaaggaaaattaagagatttttgtcaacagcagacttcttctaagagaaatgctgtaggttcttcttcaggtgaagggagatgatatcagagggaaacatggaactttgggaataaatgaggagcaacagaaatggcaaaatatatgggtaaatgtaatgtataatttttctccttttgaattctttaagatatatatgatagttgaaagcaaaaaaatataacactgtctgagggatttaaaatgttattagatgtaatatgttcgaaaactgtaacatgaaagaaattaaagatatctatactgttgtaaagcttctacatattacttgaagtattaaactataagtagaatgtgaaaggttgtgtgtgactatcttagtatctacagcagccactgattttaaaaaataacaaccaggcatgacatcacacttctgtagtccaagctacttgggagagtgaggcaagaggattgcttgtgcccaggagctcaagatcagcctgggcaacatagtgagaccccatcttaaaaaataaataaataggccaggcacggtggctcatgcttgtaatcccagcactttgagaggctgaggcgggcggatcacgaggtcaggagatggagaccatcctggctaacatggtgaaaccccgtctctactaaaaatacaaaaaaaaaaaaaaaaattagctgggcattgtggtgggtggctgtagtcccagctactcgggaggctgaggctggagaatggtgtgaacccggaaggcggagtttgcagtgagctgagatcgcatcacgccactgcactccagcctgggtgacagagcgagactccgtctctaaataaataaataaataaataaataaatagggcaggacacagtggttcacgcctgtaatcccagcactttgggaggctgaggtgggtggatcacctgaggtcagaattcaagatcagcctgaccaatatggtgaaacctcgtgtatactaaaaatacaaaacttagctgggcgtggtggtgtgtgcctgtagtcccagctactcgggaggctgagaaaggagaaacgcttgaacctaggaggcagaggttgcagtgagccaagattgcaccactgcactccagcctgggcaacagagcgagacaccatctcagatagattagatagatagatagatagatagatagatagatagatagatagatagatagataaagatagatgatagatagatagatagatagatagatagatagatagatagatagatagataggccaggtgtggtggctcatgcctggaatcccagcactttgggaggctgaggcgggtggatcacttgaggtcaggagttcgagaccagcctggccaacatggtgaaaccccgtctctactaaaaatacaaaaattagctgggtatggcagtgtgcatgtgtagtcccagctacttgggaggctggggcaggagaatcgcttgaaccaggatggtggagcttgcagtgagccaagattgtgccactgcactccagcctgggcgacagagcgagactcgctctcaaaaaaaaaaaaaataaataaataaaaataaatacatacatacataaaaatttaatttaaaaacaaggagacagtgacaaacagtaaagaggtatgtttaaaatataatatttaaattataattgcactactggaaattcatcccagggaaataaaaacttattacaaaaacctacagagaaatgtttgtagcaaatttattcgtaatagcccaacactggatacaacctagatgtccttcaacaggtgaacggttaaacaaacatgcataccatggaatgctactcagcaataaaaagaatcaagcttgatacatacaacaacctgaacgaatctctggaggattatgctgagtgaaaaagaactaatcccttaaggttacatacagtatgattccattatataacatttttcaaatgacaaaattatagaaacagagaacatattagtagttaccaggctataagaggagatgggctgggagaaaatcggtatgactataaaagagtgacggtcaggtgtggtggctcgcgcctgtaatcccagcactttgggaggccaagttgggcagatcacttgaggtcaggagttcgagaccagcctggccaacatggtgaaaccccatctctactaaaatacaaaacttagccaggtggtggcgggtgcctgtaatcccagctactcgggaggctgagacaggagaattgcttgaacccaggaggcagaggttgcagtgagaccagatcgcaccattgcactccagcctgggccacagagcgagaatccatctcaaaaataaataaataaataataaaaagagtgacatgagggatccttgcagtgacagaaatgttccatatttgatctgtatagatgtcaatatcctggttgggatactgtactacagttctgcaagatgttacctaccaatggggggaattggataaagggtacattacgatctctttgtattacttcttacaagtgcatgagaatgtataatgatctcaaaacaaaaagtttaagaaaatattcaaatgttccaaagaagagaggaatgggaaaatagaataacaacaatcagcaaaagggggacaaagaagaaagaaataataaaatggtagacctacatccaacaatatcaataattacaaaaacacaccaattaaaaggcagattgtcagttgagattaaacacacaagattcaactatatcatgtctacaagaaacgcaatttaaatataaagaatctgtgttcaacaagagacacaagaaagacagtgaaaagacaatctagactgggcgcagtggctcacgactctaatcccagcactttgggaggccgaggtgggtgtattgcctgagctcaggagtttgagaccagcctgggaaacatggtgaaatcccatctctactaaaatacaaaaaattagctgggcatggtggtgcatgcctctaatcccagctacttgggagactgaggcggaagaatcgcttgagcccgggaggtggaggttgctcaggaggtggaggttgcagtgagccaagatcacaccactgcactccagcctgggtgacaaagcaagactctatctcaaaaaaaaaaaaaaaaaaagacaatctaacaaagggacagtatgcttgcaataaagcattgattaatatgtactctaccgaaaatagtgccactaggcatggtgtctcatgcctgtaatcctaacactttgggagactgaggcaggtggatcgcttgagcccaggagtttgagaccagtctaggcaacacggcaaaaccccatctctacaaaaaaatacaaatattagctaggtgtggtggtgcatgcctgtagtaccagctactcaggatgctgatgaggaagtaggatcacctgagcccaaggaggttgaggctgcagtgagccatgatttcctgggcaacaaagtgagacactgtctcgaaaaaaagaaagaaaatagtactatgggccgggcgcagtggttcacacctgtcatcccagtactttgggaggccaaggcgggggaggggggggaggtggatcacctgaggccaggagttcaagaccagcctggctgacatggcaaaaccccatctctactaaaaatacaaaaattagccgggtatggtggcacatgcctgcaatcccagctactcgggaggctgaggcaggagaattgcttcaacccaggaggcagaggctgcagtgagctgagatctccccactgcactctaccctgggcgacagagcaagactctgtctcaaaaaaaaagaaaagaatagaatagaatagaaaagaaaagaaaagagtgctatgaataagtaggaggaaggcacataccataagaaataaatgagttgaagacttacgcaggcaccgtgtaagatttacacaagtcactcaagttctctataaaatatgaaatgaggatcaattacattactaatcaaggaaatgaaagtttcaatcacaataagatactaatacacacctaccagaatgggaacaaataaaagtctgacaagcagaagtggcacggagggagcatctacaaatgttttacaaaccaacaacatttggccttatctataaattattcacacctccagaacccagacaccacaacctaggtatatacataggaaagctctcacagcaaatgttcctagcaaacatgtaaaataatggcagtattatcattaactatactagccttaaaccggaaacaacccaaacaccatcaagagagtaaatactggctgagtgcagtggctaatacctgtaatcccacactttaggaggccaagacaggaggactgcttgaggccaagagttcaaaaccagcctaggtgacataacgagaccccatctctatatgaaaaacaagaatagctgagcacagtggcacatgcctatagtactgtctactcaggaggctgaggcaggaggattgcttaagcccaggagttcaagcctgcaatgagctatgatcacaccactgcactccagcctaggtagcagagtgagaccctgtctctaaaaaataaataaataacttaaaagagagaagagtaggtacttttaattgtgtgatacccaaactagaacactatcctgcaatgaaaataaacatcatggctgaatctcacaactatagtagtgaataaaagaaataagtcacaaaataattcatatggatgattctgtttttacaaagctcaaaaaagaaaagttcaaactaaacaatatattgcctgtgtatacaaatatagatagcagaagctctaacaaaaatcttaaaaataattacccccgaatttgggatacaggttacatccaggagagaggtaggaggatgccatctggaaggggtagagtcgtagttctcaacctgagtggtgattatccaggtgttagctatatatttcttctgaaaagtacgcacgtgttctaaatgctcttctgtatgcaagatatagtaatcaataaggatttctttctatctcaaagaaatagaaaatgaaaaacacaaaaataaacacaatcaaaagctggttctgtgaaaagatcaatacaatggataaatcttaagtcagactgatcaagaaaaaacatacattatcaatatcaggagaacaacattacagatcctacaaatattaaaaaataataaggaaatcttatgaaaaaaactttattttattttatttctttatttttttgagatgaagtctcactctgttgcccaagctagagtgcagtggcacgatcttggctcactgcaacctccgcctcccggtttcaagcgattctcctgcctcagcctcccgagtagccggtactacaggcacgtgtcaccatgcccggctaatttttgtatttttagtagagacagggtttcactatgttggccaggctggtcttgaactcctgacctcgagatccgtctgcctaggcctcccaaagtgctgggattacaggcgtgagccaccccacctggccaaaaaaaactttatatcaaaaacttggtagtttagatgagacaaattccttccaggccacaaaccaccaaagcttgctcaagaagaaaagagttatctgaatatacctataattataaaaaaacaaatttgtagccgggtgcagtggctcacacctgtaatcctagcactttgagaagccgaggctggtagatcacctgacatcaggagtctgagaccaccctggccaacatggtgaaaccctgtgtctactaaaaacacaaaaattagctgggcatggtggcgtttgcctgtattcccagttactcaggaggctgaagcaagagaattgctcgaaccaagaggtagaggttgtggtgagccgagatcgtgccattgcactccagcctgggcgacaagagcaaaactccatctcaaaaaaaaaaaaaaagaatttgtagttcaaaacttaccctccaagaaaactctaggcccagatgttttcactgatgaagtctacagaacatttaagaaataatgctagtcctatataaatttcagaaaacagaagaggaggaaacacttcccaactcattttatgaggccagcataaccctgacgtcaaaaccagacacaaacagtgtaagtgaagaaaactacaaatgattatgacacatagcatagatgcaaaataacaaaatatgagcaaaaataaataggagcatatcaaaggaatgataggtcattatcaagaggggtttacacaggtaatgaaaggctggttcagtatctgcaaattggctaggcatggtggctcacacctgtaaccccagcactttgtgaggccaaagcgggtggatcacctgaggtcaggggagttcgagaccagcctgaccaacacgaagaaaccccgtctctatatatatacacacaaaaaaaattagccaggcatggtggcaggtgcctgtaatcccagggatgctgaggtgggagaaacgcttgaacttgggaggtggaggttgcagtgagctgagatcgtgccactgcactccagcctgggcaacagagattccgtctcgaaaagaaaaaaagaaaaaaaaaaaaaagaaaaatctgcaaattgactaggcatggtagctcacacctgtaatcccagcactttgggaggctgagatggaggatcacttgaggccaggagttcaagaccagtctgggcaacacaacaagacctcatctttacaaaaaatttaaaaaatagctgggcatggtggtacatgcctgtagtcccagctactctggaggctaaggcaggaagatcacttcagcacaggcgttcgaggctgcaatgagctatgaccataccactgcactccagccttgggaacagaacgagactccatctctaaatataataataattaattaatttaaaaataaaggagaagaagtatgatcatattcattgatgcagaaaaagcatttgcaacattcagcatcaattcatgataaaaattcaaaaaactaagattaaaaggaataatcctcaagcattgtcagcccaccaatggaaaactctacaaataaaaaattatacttaatgatgagaaagtgagtacttttgccctaaaatcaggaataaagcaaagaagtcattctcactatgcctattcaacacaatactaaagatcctagccagtaaaaaatggcaaaaagaggccgggcatggtggctcatacctgtaatcccagcactttgggaggccgaggcaggcagatcacctgaggctgggagttcgagaccagcctgatgaacatggagaaaccccatctctactaaaaatacaaaaaaaaaaaaaaaaattagctgggcatggtggtgcatgcctgtaatcccagctacttgggaggctgaggcagaagaatcgcttgaacccaggaggcggaggttgtggtaagccaagatcataccattgcactccagcctgggcaacaaaagcgaaactccttctcaaaaaaaaaaaagagggcaaaaaaagaagtaaaggacatccagattggaagggaagaaataaaactgtctttatttacaactacatgattgtttacataggaaatgtcaagctatctacaaaaaagttacaagctatctacaaaaaagttacaagttttaatatgtacacttagaaaggtcccagggtacaagatcaatatacaaaaatcaatggcatttctataagatagtactggccaatgggaaattgaaattaaacaaaataccacttatagtatcttataagaacaaaaaaagctggtattaattaaacaaaatgtgaaagacttatgcattcaaaactacaaaacattgagataaaatttaagaagatctaaatagagatacatgctattcattaattggaagactcaatattgtcagtatatcaatgatccacagattcagtgtaatcccatacaaaaatccctgcgggcttttgtgtacaaattcacaagctgattctaagatttatataaaaataccaaggacctagaataggcaaaacattaggaaaggaagaacaaagttggaaaactcatacttcctgatttgaacacttaatgttaggctacagtaattaaacagtgtattaatgatgtatagacagacacatctctgttcaactgtttggttttttttgagacagggtcttgctataccccaggctggagtggcagtggcgtgatcacggctcactgcagcctcgtcctctcgtgctcaagcaatcctcccacctcaacctcccaagtagtggggagtacaagtgcatgccatcatggttggcaaattttttaaatattttatacacgggggctcactatgttgcctaggctagtctcaagctcctaggctcaactgatcctcccacctcagcctcccaaagtgcttggattacaagtctgagtcactgtgcccggccattcaaaggttatcagcaacgatggcaaagtaagtcaacaacaacaacaacaacgaagagtattttcaaaactgctgctggaaaaattggatatacatatgcaaaaagccccctgaccctcacctcatgtcagatttacaaacttaactcattctttgtcataggtctaaatttaagagctaaaattataaatcttctgaaagaaggcataggagaaaaatctccattgctctgagtcagagatttgttagataggatacaaaaggcatgaaccataaaagaacttgataaactcagccttatcaaaattaaaaacgtctactctacaaagcacagttaagaaaaaaagaagccataatctgggagtacatacttaaaggacttgcatcaagaatatataaagaacctgctgggcacagtggctcacacctgtaatcccagccctccaggaggccaaggcaggtgaatcacctgaggtcagttcgagaccagcctggccaacatggcaaaacctcgtctctactaaaaatacaaaaattagctgggcatggtggcgggtgcctgtaatcccagctactcgggaggctgaggcaggagacttgcttgaacccaggaggcgaggttgcagtgagctgagattgcaccactgcactccagcctgggcaacagagcaagactccatctcaaaaaaaaaaaaaagatatataaagaaccttacaatttaatagcaaagaaaaatggcaaaagattacaacaaatacttccacaaagaagatataaagatagcaaataagggctcaacaatattcatcattagaaaaatgcaaaattaaatcacaatgagatccccctacacacctactagaaaaaaggactaacactaacaataccaagtgctggcaaggatgtgaaacacgtggaactcacatacattgctagcggaaaaaaaaagtggtatagccatgttggaaaacagtttagcagtgttttataaagtattccaacctgggaataatgttctctcaagtttatttttgaataaataaagagataatataaaaaacaagagttgagtgggaggaaggtactgaaaacaggaggaatctgaaaacaggtggcatcaagtcagatttgtaagagtctgggaaggaatacaaagagaaaatagaaaacagtgtgaggtttacagtgtttaccacaaaataagagcaggcaagaacatggtgggtaccaggctgggtagagtaaaggtcaccagcaaagctttgttgcctataccaactccaaaaaataatgtatgataatttccttgagtctaaaaaaaaaaaaaagactccaactttcagcctgaaagggcccacagtatgcccaataaagaggaaatgctgacatttgcatctagtctggtaaaaatacataagcacaagaagggagaaaaagttctaaaagcttccagaaaggacagggtgagaggaatgagaaggggcttggcacttctcactaacaagccaggaggctggaaggtagaaatgggatctcagaacaagagtggccacaatctatgtgaatgccaagcaaagaacacagagcctgtaaccggcggccaggcagaagcctcatttggacatgacaacagttctgctcatcagagcctaggcatgtccacaagtccgaggctctgagaagagctcctgagcacatcccagaggccaagctctcaccaaccaacctggtcccttttccctggcctgactcacctggcctgtcctcacctgcacaggtccgtaccggggtccctccatctgccatccaggactcgtcacctggtcccaacctgaagatcacatctggcttcccaactagatgccctgtttaggggacatgacataggactttgttattaatgctgaggaattccagaacctaggcccacccctgcaggctgaaggtggcacggcctcggtgatggccccatgcacacagctatctgcccctcagtacagaacattcacatagcaagcaagggcaccaatatgctctccagtgtccaaaggagactacaaatactacacagtgggcagtaacccaaactcactgagggtggtaacccacactcattgttcctaggccccagagcttggagcagctgagaaagaaacacagtactggaggcattctgcatcaccctgtggcgcggtccctcacccacggacaccaggtggctgtagttctcaagcatgacatccctgtagaggttcttctgggcagagtccagttgctgccactcctccagggtgaagtccacaaacacgtccttgaaggtcaatgattcctgtaacggcacattcctctttagcaccccaggaccagcctggggcactgggacatggcacctcacacacacggagggcttactctgtgccctttgaggtcctttacatgtactaaagatttcagtcttcgccgccaccctagaaggaacttgacagatgaagagtgtgaggcacacagagcctaaataaccagtccaggtcacacagccaggaatgagggattcgaatccacgcagtctggctcccgcatccacgctggcctttctttatataactgttcttatgccagtcactagtcagtttggcatagcatattacatagagtatatgactaaaatcattttgaactttataggagaaagagatagagtatgagaaatatcttaccctggaaattcattcattcaacacatgtttactgaatagaggccaggctggtaagtcctgtgacataaagattgatacaaaatgacaccttggccgggcgtgatggctcacgcctgtaatcccagcactttgggaggcctaggcgggcggatcacaaggtcaggagttcaagaccagcctggccaatatggtaaaaccgcatctctactaaaaatacaaaaaatagctgggcatggtggcgggcacctgtaatcccagctactcgggaggctggcgtaggagaatcgtttgaacccaggaggcggaggatgcagtgagccaagatcacgccattgcactccagcctgggcaacagggcgagactccatctcaaaaaaaaaaaaaaaaagacacctcttaaactcaaggagcttcagtttagtggagggagaaaagcgacacttagacactcatagaagaaacagaggcagcgaggaagcctgcctcacagggacagtgacagatgtaggacggggtccgggttgtccacaaaggaagaagtcaattctgcttagcgctgacagagcaggccttgcaggggacacagagctacaacaaacagttctaaacatagctaatcaatcatgacaaaccgttctaaccttcactcatcaatcatgaaacaaagaacaggaagccagaggtttgtggcctgggcagctgactgaagcaaaaggggaaaggtctgtgcttggccttgtcaccaccaaacaagaactcacttctacaagtgcccccaattccttgcaaagactaataacccgcctgtttctgctccagatcctatcctgtaacgcccacacttggtggccttcaattcaagccactcgctgcacccataaggcccaaatcagccacagtggcaccagtttacccagctgtgcaggagaggggcaggaaagccagtgtgccagagggcggggacaggcaggtttctccagcaggagggcttctcagagcaatccaggagctgttagcccaatctgcccctccctcgtgatagctccggtgctggggaacaaaaccacactgcggagtgctaggatgatgttgcttggaagccctaacctgttccatagaccagtatctcttgtaatggtcccagtggcatggcttcgaggatcccagcaaaagatgggcccagttacatatcactgagtgacaatgtgctcagaaaaccccaatccatggcttcctaccagccagtcatagtttactcagtcctccagtccagatgcagtttgtttaaccaatccagagtcaattttatctggagtaatgtcacctggtttgatattgtgaaatatatatttggtttttgtcctgtctcctggcaagaagctcctgcaacccttggaatagcctctgaagtgatcaaagtgtcttttatatgctaatgagatgactgttagctggctgcccctaggtagcttctggatggaagctggtcaccagaaaaccagacaggattagaaggttgggaatttcatctccatcctcaaaactcctgggaggggagaggagatgaaggttgagttgatcaccaagggccaatgatgatcatgcctctgtgatgaagcctccgaaaaaccccactgtggctgggtgtggtggctggctcctgtgatcccagcactaagggtggctgagaagggaggatcacttgaggccaggaggttgggcctgcagtgagccaagactgcaccactgttctccagcctgggggacagagcaagaccttgtttctcaaaaacaacaacaaggacaacaaccaaagggctgggtgggttcagacagcttccacacagctgaacacttggtggttcccggatggtagtgagtccagagagggcatgaaaggtctgtggaccttcccacatcccttgccctatgcatctcttccatctggcggttcatctgtatcttctgtaatatcctttataacaaataggggaaattcagtttccgttagttctgtgactcactctagcaaattaatcaaacaccaggagggagtcaagggaacccctgatttgtgtcccatcaatcagatgtatagatgataccctactcgagactggcatctcaggtgggggtagtcttgtgggactaagcctcaacctgtgggagctgacgctaactccaggtagatggtgtcagaatggaattgacttagaggagacccagctggtgtccactggagaatgacttggtatttgggtaaacagcctggggcctgggattacatctcgtgtcaggagtgttgtgtcaagtgagagtagacagtaggaaaaacttgggtttccttccttatctctcagacccagtaaaacagccatcattccactgtcacgtttctagtcacacacagctaaatatgacaatgatgatgaaagttaataaccactaacagatcctctgagtagagtgtcagaggttacttcataaaaatgatactgcctgtgcacatgtaccctagaacttaaagtataataaaaaataataaaataaaataaaataaattaaaaaaaataaaacatatgtatgtggccaggcgcggtggctcacgcctgtgatcccagcactttgggaagccgaggcaggcgaatcacgaggtcaggagttcgagaccagcctggccaacatgatgaaactccgtctttactaaaaatacaaaaattagccaggcgtggtggcgggcgcctgtaatcccagctactcaggcggctgaggcaggggaatcgcttgaaaccagaaggtggaggttgcagtgatgagccgagatcacgccactgcactccagcctgggcaacaagagcaaaactccgtctcaaaaaaacaaaaaacaaaacaaaacaaagtatgtatgtgactctcttaacaactaaacctcctctattaggaatcttactactgtgttacttcatctcaaatcttttaatagtctcctggtgactttgagaagtatcatgcagaaaacctctgcattttcactccactttgaaactggtcatgtcttgggaactgactcattctactaatcatatagcaaagagaaaaaacatagttcttagtttaaaacatgagcaattcattgtgtcacatatctttgtgttttggtaaattcatcattagagagagagaaaaaacatcaatggagtttaaaccctttgtctcgttaagtcgcaaaaaaaattattggactaaataaaccacgcagtgtcaagttcaaaaaagaatgatactgccttcacaaaaattgtaagagtgagaaaattatgacattgaaagagatctgatctaaccaacccctatcttgcctttaacctccaaattacccttaatcattcctcggcctggcccaagaaaactttgagagacatttgttttatagtttaaaagataatagaccacaggtgtccaatcttttggctttcctgggccatattggaagaattgtcttgggccacatataaaatacaccaacactaaagatagccgatgagctaaaaaataaaaatcacaaaaaaagtcacaataagtctcataatgttttaagaaagtttacaaatttgtattgggccgcattcaaagccatcctgggccgcatgtggctcatgggctgtgggttggacaagcttataatagccttctgcaaaactcaaccacctttgtaaagctgagaggccacaaggttaggaggatatgaggaggctaaaatctgctaacatgtagacataaaagatttccagctattattccggaggtcacaagatttggaactccccaattactcccgcagataatatcaccattatagaacctaagattggccttttgaggcattttttcaagtttttgcatttctgacgaccagtggctccaccaggactggccaacctccaccaaccggtcctatggccccacccagaagctgaatccatggcctaccaaactatccttgaaaaaccctaccctccaaattttcggagattgatttgagtaataactccatctcccatgtggcatggccagacttacatcaattaaactctttattgcaatgccgtggtctcagtgaattggttttgactgtgcagtgggtgggaataacccactggctggttacagcaaaaataaatcagccagacacggtggctcacacctgaaatcccagcactttgggagtccgaggcgagtggatcacttgaggtcaggagttcgagaccagcctggccaacatggagaaaccctgtctctactaaaaatacaaaaattagccaggtgtggtggtgcacgcctataatcccagctactcgggaggctgaggcaggagaatcacctataatcccagctactcaggaggctgaggcaggagaatcgcttgtacccgggaggtggaggttgcagtgagccgagatcatgccactgcactccagtcctccagcctgggtgatagagtgagaccctgtctcaaaaaaaaaaaaaaaaaaatatatatatatatatatatatatacacacacacacacataaaatctatgcagaaaagatgacattaggaaaatctggtggattagtccgttctcatgctgttgataaagacatacctgagactggctgatttataaaggaaagaggtttaattgactcagttcagcatggctggggaggcctcagaaaatttacactcatggcggaaggtgaaggggaagcaagacaccttctttacaaggtggcaggaaggagatgtgcaagcaggggaaatgccagaagcttataaaaccatcagctctcatgagactcacttattatcatgagaacagcatgggggaaaccgcccccatgacccattaccttcacctggtcccgcccttgacacgtggggattacaattcaagatgagattttgggtggggacacagccaaaccatatcttctggctaggtatttatggaggaaaataactcaataaaactgaattacccatctcactctgaaccctcaaataaattacacagggatgagacaggtctccctctgtcatccaggccggagtgcagtggtgagattatggctcactgcagcctcaacctcccgggctcaagcgatcctcctgaactcaagtgatcctcctgcctcagccccgcaaagtatctgggactccaggcacacgccacctcacccagctaatttttgtattttttgtagaaacgaggtttcaccatattgccaggctggtctcgaacttctgagctcaaatgatccacccgtgtcagcttcccaaattgctggaattactggtgtgagccaccgcacccagccttagagatttaaatgtgtacaagataaccataaaatagatcaaagtttttataattttacagtggctaaaagcctttcttttctgtgttttttttttcaagacatagtctcactctgttgcccaggctggagtgcagtgttgtgatctcagctcactgcaacctctgcctcctgggttcgagtgattttcctgcctcagcctcccaagtagctgggactacaggcacccgccaccatacccaactaatttttgtatttttagtagagacggtgtttcaccatgttggccaggctggtctcgaactcctaacctcaagtgatccaccaacctcaacctcccaaagtgctgggattacaggtgtgagccaccgcttccagccggctaaaagcctttctaagcaatccccaaattcagaagacatacagtcacagactgatcaacatgactgcctagacattagaaatttctaaatagcagaatgaattttttttctttttttttggagacagggttttgctgttgttgcccaggctggaatgcagtggcatgctcacagatcactgcagcctcgacctcctgggctcaagcgatcctcccacctcagcttccctcgtagctggaactataggcacgcaccaccacgtccagctaatttttgtattttttgtagagacaaggttttgccatgttgcccaggctagtctcaaattcccgagcttaagcaattctcctgcctcagccttccaagtgctggggttacaggcatgagccacagcacttggccaaaaattatattatgaaacatcaatatcaaagtgagaaaagtattagaaatatacaaaacaatgggctaatttcctttatacactaaaattctaacaaatcattatgaaaaagaccacaacctaacatataactgaatgaatataaaataaatatataacttaccatgtatccctttcatagtcttaaaaactaaaaaggttaataatacttagtacagtcaagtatgtagaaaaaacaccaaagaagttataaactatttacagcatttttgggaggaataattggttaatatatatcaaattttacattgcaaataccgtttaacaaagcaatgacctttctaggattttaccctatacctttaacacatcagtaagaagagacagcccaacagtatgaataaaatgctcatagcaacagaaatgttagaggcctagaaacacaaaaagattataagcctcactaaaagtcacatatatgctcattaaataataagatattgtcttttatccataagagtcactgctgatgaagagtattagaaattaaatactctcatataaaggctgattgatacataatttggttatacctattaaaggtatttgtttcttactttaaccagcagttgcatttacaggactctattctagtgaaatatttatgtgtacataaggatgtccaaggcagtcctattcgtattaacaaaaagtagaagaaagctctaaaaggtctggcacagtggctcacacctgtaatctcagcactttgggaggccaaggcaggtggatcgcttgagctcaggagtttgaaaccagcctgggcaacatggtgaaaccccatctctacaaaaataaaaaagggctaggcgcagtggctcactcctataatcccagcactttgggaggctgaggcaggcggatcacgaggtcaagagatcgagaccatcctggccaacatggtgaaaccctgtctctactaagaatacaaaaattagctgggcatggtggcacgcacctgtagtcccagctactcaggaggatgaggcaggagaatcgcttgaacctaggaggcagaggttgcagtgagctgagatcgtgccattgcactccagcctggcaacagcaagactccgtctcaaaaaaaaaaaaaaaaaaaagttagacgggcatggtggtttgtgcctgtagtcccagctactcaggaagctaaagtggaagaactgcatgagcccaggaggctgaggttgcagtgaaccaaaatcatgccactgcacttcagcctgggcaacagagtgagactctgtctcaaaaaaaaggaaaaagaaaaaaataaaagaaaaagaaagaaaacccaaatgtcctgtgttcctgggaaccccaaaatggtagaacaacagctgtattaccaggtgacattgcttatgagaaaaatgacccctgattggtaaataatctgcatgtggactaggactagagcgtagttaaataaattgctccatctatactctggaactgtcatgataaaaattgactcacacaggacgggtgtggtggctcacgcctgtaatcctaggactttgggaggccgaggcaggtggatcaactgaggtcaggagtttgagaccagcctggccaacatggcaaaaccccatctctactaaaaatacaaaaattagctgggcctggtggcgtgagcctgtaatcccagctactcaggaggctgagaaaggagaatctcttgaactcgggaggtggaggttgcagtgatccgagatcgcaccactgtactccagcctgtagagcaagattctgtctcaaaaaaaaaattgactcacacataaggatgcctgggatacttttgtctaaatgaaaaaaaaaaaagcaaatttcagaaaagcacagtaggagcatattttcattaaaaacaacccatgcaaaatgttgtggttttgtatatatataaaacaaaaaaattctgaaaggcaaacagtagaagggctgagactgggttcatttgttggaatgcaacagaaagggaggaatgaaaattggccctgttttcctggcttgaaaactggaaaaagtaaatatcctttcaaatggcatcatatttttttcttataaattgcctgccttatctttttgactcctttctaccacatttttttgttttttaatcattgttcatattacatacataaatcctctgtgtattatatgcattgcaggtattttctctcagcttcaaatatgtcttctgactctacaggttttaacattttaatacagtctaatctgacaatatttccctttatgatttctgggttttccatcttcattaaaaatgtttcttgcagggccaggcgtggtggctcacgcctgtaatcccagcactttgggagattgaggcaggcagttcagttgaggtcaggaattcaagatcggcctggccagcagggtgaaaccccgtctctactaaaaatacaaaaattagccaggtatggtggcacatacctgtagtctgagctacctgggtggctgaggtgggagaactgcttgaacccgggaggcggaggttgcagtgagccgagatcgtgccactgcactccagcctgggccacagagggagactccatctcaaaaaaaaaaaaaagtttcttgcactgcataaagttatccatatatcctcctaaatttttacccaatttttcaaatatatatttaggtctacaaccaatctagaattcacttttatatgatatagaagagtctttgtttccatacagatactcaactgtgccaccatcattcagtaaccactttttccacataactgaaataccatttttataatcttgactcacagaatcctatataagcaataaaagaaatctagaagtcacaaaagattgtgaaattagaccacattaacaaaatgtaagtgtccactccccaaaattaataagacaagtcaaagcaaatgaagtatgaaaaaatatttgcaacatatatgatagagatcttatttacttgagttaacataaagggctaccatccagcaatcaaattaattccacacccaagagaaaaggaggcaaatgactagaataaataattgaaataaggaagtacaaatgatggttaaaaaaaatgaaaagaagactgggcacagtggctcacacctgtaatctcaccatactggaaggcgagggtaggagaattgcttgaattcaggcattggagaacaacctggccaacacagtaagactccagctctacaaaaaattgaaaaattagccaggtgtggtggcatgtacctgtattcctggctacttgggaggctgaggtggaaggactgcttgagcctgggaggttgaggctgcagtgagccatgatcacaccactgcactccagcctgggcaacacagcaagactctgtctcaaaaaacaaatagcccagtgcaatggctcccacctgtaatcccagcactttgggagaccaagacaggtagatcacttgagctcaggagttagagaccagcctgggcaacatggcaaaatcctatctctacaaaaaatacaaaaattagccaggtgtggtggcacacgcctgtggtcccagctattcaggaggctgaggcaggaggatcacctgagcctaggaggtcgaagctgcagtgagctgtgatcgtgccaccatactgtagcctgggtgacagactgagaccctgtctccaaaaaacaaacaaacaaaaaatatgaaaagacactaatttcaggaaatgtgaattaaaatgcaccattcttatatgctgcatcatggcaaaaatcaaagcattggataatgcactgtgattgcccacttacgtgaaaaggcatatactgccgctaggagtacacatcagtatattctatttggagggcaaattgacagttctgaatcaaaattcatgatgcacatgaatctgacctagaaatctcacatctgacatactcacatgcaggcaacggaatgtactgtacattgctatgctgtttatagcagcaaaagactagaaatgtcctaaatgttcatcactaggagaaaggtaaatgaatattggtgttcccatgcaatgaaataccaagcagttgcttttgcaaacaaggtagaccactggttttaaacattggataattctctcccctaggggatatttggcaatgactacagatactttggttgccaaaacttggggagggattctactggcacctagtagagatagaggccagggaccctgctacacatacaatgcacaagaaagcagccacaacaaataatgatcagaaccataatgacaatagtgccgcagtaagaaaccctagggacaactaaatacaagtaaagtggaatgatcatgaagacaagaccagaaggaccagaatgagctctaatttgttagagaaaaagcgtgtcagagtgagaactagcacacacaggagtgagcagacaaagagattcatacatcctggccgggtgcgggggctcacgcctgtaatcccagcactctgggaggccgaggagggcggatcacgaggtcaggagatcgagaccatcctggataacatggtgaaaccccgtctctactaaaaatacaaaaaattagccgggcgtggttgcaggcgcctgtagtcccagctactcgggaggctgaggcaggagaatggcgggaacccaggaggcggagctcgcagtgagccgagattttgccactgcactccagcctgggcgacagagcgagactctgtctcaaaaaaaaaaaaagaaagattcatacatccagacagataagcatacatattctctgaaagactgtaccaaaaaatgaaggaatcttgaggatgggagaattattttttgccttttcttgaacaaaactttcatttgaatttttactatgtgtatgcattacttttaaatgttcaattttttaatgctctattcagaatacttttacattttgacatccatgttcttaagggaaactggtctataattttcttttttgtagtatcctcttcaaatttcaggttaagtggcttcacaaaatgaactgggtaccttttcatctttaatagcctggaaaaatggaacgcagaaattatctagtctttacatttagtgaaaggagtaattatgaaggatttcggagggcaaatttaagtctcactaccttttagtcaaaacccgacttccaggtataacctccataaacactggtactacagagcaagtagatacagagaaaattgttcatgaggtactgtatacaatagtaaaaaaaaattaggccaggtgcagtggctcatgcctgtaatcccagcactttgggaggacgaggtgggtagatcacctgaggtcaggagttcgagaccagcctggccaacatggtaaagccccgtctctactaaaaatacaaatattagccgggtgtggtggcacgtgcacgtaatcccagctacttggaaggctgagataggagaatcgcttgaacctgggaggcagaggttgcagtgagccgagatcacgccactgcaccgcagcctgggcgacaagagcaaaactccatttaaaaaaaaaaaaaaaaggccaggcacggtggctcacacctgtaatcccagcactttgggaggctgaggtggacagatcacctgaggtcgggagttcgagaccagcctgaccaacatggagaaacctcatctctagtaaaaatacaaaattggctgggcatggtggcacatgcctgtaatcccaggtactcggttggctgaggcaggaaaatcgcttgaacctggaaggcggaggttgcagtgagccgatatcgcaccattgcactctagcctgggcaacaagagtgaaactccgtcacaaaaaaaaaaaaaaaagaaaaagaaattaaaaacctaaatatctgtgaatagaaaaatagttacatgatacatccatactatgaaataggaattaaaacaatctttatatattgacaaggaacaccacccaggatataatcaggttcagaaagcaagatgggtatgggaatatgatgccatttgtgtaaaagcataaaaaaaatatatacgtgtacgtttttagttcattaaactgacataaatgcatctaccccacagtttcacccaactgttaacagtggacatctctaaggaggaacgtggtactggggggagaagaaatagaaactttattggctactagtttcttctatgtacattaaaacattatacacaaacttattctcttaaacacagtaaaaaagaccaagcgatctagaagtgaagaaagaggaaaaagcaaggtgaatctatgtatttaaacaattcttctctgagaagaagaagaaaagatgaggtacagtttctggaagaacaagtagagagaggtatctttttgtttttcctctctcctggtgaggggaaggattagagaaaccagaggctgaggacaagttgaacagaaaacagccagagaagaggggataattggtattttcaagtttattatatagattccaaactttgcctcaatttcactggaaaaaaagtaggggtacattagaactcacctgggacatggccatcttgttgtgctcctgcaaaggatggagatctacaaatacagaattagaagggttgagttcagtgggtatagacataagatcatcatcaccaccctaataataattacctttgcaccctgggaagaatcatctaaaaataaggcctggtagcttcagcctattccatgggacgctactaagatcatgtgggttttgcacatgaaactttgtctcccttactggacagatgtatgacttgtgtccaaagccatctacatgtcagaaaccagtaacaacttaacatctcctttatctcaagagttctattcctagcacaaagatgcaaaatgttcaccattgtcatttccactatgaaaaatctgcctataatccctgcatgcggggggcgctgaaggaggattgattgaggccaggagttcaagaccagcctagacaatatagcaaggccttgtctctacaaaaccgaaaattaaaaaaattagctggcgtggtggtgcatgcctgtagtcccagctactcaaaaggctgagatgggagggtctcttgagcccaggagtgcgaggttagtgagccatgatcacgtccctgcactccagcctgtgtgacaacgtcagagcctggctcaaaaataaacaaaaaaataaaaaaatcttcgaagcaactaaatgtgcagcaaaggggacttagtaaaaaaatatgacacgtgcaaaacaagcatactacacaggctttaaagatggtttctgaactttgttttcagttcctgggtgtttaaagggaggttccaacaaagcaactgcagtgtaatctcatttttgttaagcaatatgtacaaatatgaagtctcaaacagcatttattcttttttttgtttttttttgagatgcagttttgctcttgttgcccaggctggagtgcagtggcatgatctcagctcactgcaacctccacctcccgggttcaagcgattctcctgcctcagcatcccaagtagctggaattataggcatgcaccaacatgcccagctaattatttttgtatttttagtagagacggggtttcatcatgttggtcaggctggcctcaaactcctgacctcaggtgatccatccgcctcagcctcccaaagtgctgggattacaggcatgagccaccgcgcctgacctcaaacagcatttattcaaatgctgacattggttacattgttcggtgattttaattttcttgtttatttgcatttttgacaaggaatattaattactaatgaaacaaaaattaaaatttattaaaaaatcacttcttatcaaacagagccctagaggtgaaaagacactctccaagtgtgtatgagtaagatctcttcatgtggtttggaggaaggagcccaaccagcgctcaaagggccgcagggaaggagaggtgtggggctgggtgggtaacagccaagcactgtcagttctgtgaggggctgaaaaccactgtgcctgcttccctgcatccacctctctaactggccacctaccctgctcccaccccaccacttcctcctttcccatgatttgcattttgattgccatgctcctccttctttggcagattttcaaaagaaagttccagcaaggagattctgtgcagagtaaccatttcatactgcagcaatcactgtgataccatcaggacaacagggttcagctccgtgtagcttagcaggtcatgtcccctggcccactttcattaagcattgaaataaggcagcagagctggatgacagcatacctagagactactctgaaattctataaactaaaaatatattttctgcactttggtcaggatgaacggacactcagcatttcccctggaagcaggtgcctggttgatggtgtggggctgactcaaattcagaaatagccaatggcaagagaaggaagcatgggggtgcacaaataggtgtgctaggagaggccaatcctctgtggctggctgtgatccttcccagcctcatcccgcctttgcaggtactacagcagggcacctgcccccatgggggacatccatgcctccatccacctgtgactttcacctgtccctcctccagcaggaatcaaactgcactgtcacatggtcctccatggcacctggaagtagagccagctttgctctgtctcagctgaagtgagggacaaaggccactacgggtccagctcttctaggacctgctgtcccgtgagcctcctttgctctgaggatctgggtctgggctcttgctgaggcttctcctccaactcgcctcagctcagcgtacctctcttgtgtccaaggcggcaggaccaagggattcagagacaaacacaccccagttggggccatcactatagcactagatctctgcctgtgacccagggaactcacctcttcctggggcctcagcctaagtcttctgcgactaagtggggaagccgaggcacagataaactggagtctgaaatcggtgagcagtggtctcaggtctgcactctgaccctggaaacacaatgaccacaggagattcaattagcaacacctatgctcccttccatgcagtgaagttgagtgaaacccaaaggtttttacccaacagaagagggacaacccctcattctagttttaagagttaacattcatgcacagctcaattatcctcagtgagcgaaaccctgccttcctgagtccgggctttggaatcaactgactggctgctgtgccacttttattcactgaagaaatgattgccttccatgagccggttctccgtgttgcaaatccatcagtgaacaaaatctcaaattcccagctccagatttctagtctggaggaagagacacactggaaacaataaacatgataaacaaagtacaggaaaagaaaaagaaaaaggattcctcgggtttgctacctacgggactttggacaggttgccaagccacactgtaccgttttctctctataacatgaaaataatcatcgtaacacctcacagggctcctgctaatgtgaaacatttgcaagagtgtctggcagttaccaccgggtgaggatacaagcgctgagtgactcaatcaattagtcactcgctggccccgaacctcgcccccaacactcacgcccaccgcctgtgtcactcaatccccacaaggacgctcacccgtggccccatgaccccacggccccgtaaactcccgtcattcctcccgtccccccttcccccgatcaaaaccatcaccacctcaccctcccgcttacttcactgccgacagcctgaaacctcaggggcggatgacaacagccagtgtgaacgaagcgccaccctccgggtcagccgagcatttccgcttcccacagccccctgggaacgtgaagtcaaagcaatgcgcacgcgcagtggctttgaaggcggggcaacaaagcctgtggccgatgtggcgctcctcggcccgcgcttcagtggttatgacagtgttcgctctaaggggagaaggaatgtgtgaccatttccaacggtaagtcgtacaaaaggtccggggaggcgtacctgggcggcgagaggcgagagaactccgcgcgggctttccagtgcccaggcccctgccggctccgaagccgaaatcccttcttccacttcgttctcttgcagtggacgtggggtgttcccacccctctgtccccaaggccactgtttctgtcttccgctcctaggaataggaaaaagagtcgcgcctctggcatctgtggcagctccagagcgcggccctctagggtccaggcaggccacatggagcggggccctaggcctggctcagagcgtcctaagagcaacaggtctggctcagtcggggaagtggcctggaagaggggctttggagccgggcttcagagccagcaacctcccgaagtgagggaagaaagcctcattctgattgttctctacccagtggtggggctccggttcctaggatcttagacaccctgggagaatctggattttactttttagcggagaggtgttttctctgagaatgccagccagtggcaacatggcccgctaaaaaggcctgtagtaaacttgaggaaagttttctgtttcctgtctgggtctgggagaaagagaacaagtgttgttctccatgcttactatgcctgcctggtcaccaagcgggcctctttgggtcaagtatgacagagtctccctcaggtacacagcaaacccttctgtgctagagccagctggtgccagacactgttcatagatgtgtccaagacatttgtgtaatctatcagacacgtatttaatttccatttgaacatgagtgtttttcctctttctctttctcctctcaggttaacttgcattccccagatagtttggatgagttacaacctaaatctgcaaactcaatacagccagaccctgggaagtgactctctccaagcctcctgtacaagtcccaggaaaagagcctgttttcccttggacatgtgagcagtgaattactgctcattcagaatttcatgtgtatgtgttactgatggccaggtttagagataccaacctatttatttctagaggagaggtgatttgataaccttttcagatatcactatcagtaggcagaaaagggttaatagtatgatagggttaatatgtcctgaggagagtaaagaaattgcaaactgcagaagcacctgatctgtggccctggccagcatctctccatatcctgattctgtaagatcaagtgtttatgcagaaagagaagggactgatgatttgaatgtgaccagatgcagggcatgcccttattgccatgccagcatttgctattcatgatgttagtattcaaaaatcaagaaacacccttcctgggccattggtgtctactaatccattggaagaaaagactggaatccaccacttactagcttcttgggcctcagtcccctcttttctgccatagctaaggaccacctaacctagatggctgttgttattgttcaaagggacatctttagagcctcaagcccaggaatagcccgtggcaggcacctggtaaatgttagttttcattgtcctatcccaacactatgaaacatgcagcactctctgcaactgcccctgtggatttccataggcaggagagtatccagtgttgagtggagctggtattctcagaaacgaagcccctttcctcattttgcgccaatctcttcagtcatttttaccctagtagtataatgctttgtcaaagtcactgtcatctgatgttaacagttgttttcgccagatgacttttcaaaaggtaacttcaccataataccggttaatgtgataaaaacactgcatgtagccaattttttttttttttgagatggagttattggctcttgttgcccaggctagagtgcagcggcgtgatcttggctcactgcaacctccatctcgtgggttcaggtaattctcctgcctcagcctcccgagtggctgggattacaggcacacgccaccatgcccagctaatttttttgtatttttagtagagtcggggtttcactatatgttggccaggctggtctcgaactcctgacctcaggtgatccgcctgcctcagccttccaaagtgctggggttacaggtgtgagccactgcacccagccaaatattttcttatttatttatttattttagagacaggatgccattatgttgcctagtttggaatgcagtgtctatttagaggcgtgatcatggcatactatagcctcggctcaaaggaccctggtctcaaaggaccctgccaccttagcctcctgagtagctgggacaagtgtgcgccaccacacctggctaattttttaaattttttgtagagatagtgtctcgctatgttgcccacgctggtctggaattcctggactcaaggcctcttcctgccctcagacttccaaagtgttaggattacagggtgagtcaccacgcccagccagtgtgaattttctaatgctgagtaagttgtgatccagaagtaaatgtatctgcaagctgatttaaattgtagattttctcttcattgcatattttctgatgttgaataaagtctgagtattaactaaagtttttgcttcttaaatatgtaagaattgtcctcaaaatctctattcttgagcacagtagtaaaaatatttttacatacattgtatttcaagggttctgcataagcaaccttgttttattgtgacaatttatttgggaattgtatcaaatatataatactgagatgttctcattccttttgtgaaaatacttttgtttaaaaaccactgccttcaaatgaaaaccactaggtttgttatgcttgcctcatcttttctcggtgtttttctttcattttttaaaaatacatgtctttcttttttatacctaaaacagtgggtttttaaaatgtgatatgtgtatgcgttgtataatggttaccacaatcaactaatacatccatcaccatccatactgtaccttagatctgcagaacttgttcatcgtagaatgtttttaccttttaggtcagacgtggtggctcacgtctgtaatccttgcactttgggaggccaaggtgggtggattgccagagctcgggagttcaagaccatcctgggaaacatagtgaaaccctgtctctactaaaaatacaaaaaattacccacgtgtggtggtgcgcacctgtagtcccagttacttgggaggcagaggcacgagaatcatttgaacctgggaggcagaggttgcagtgagctgagatcgtgccgctgcactccagcctgggcgacagagcaagactctgtctccaaaaaaaaaaaagagtgtttttattttttgaccaacatctctccatttcctgtctcccactcctgcatccccagtccttggtaaccactgttctactctctgtttctatgagttcaactttttaagatttcacctttaagtgagataatgcagtatttgtcattctgtgtctagtttatttcatttagcatactatcttccaggttcctttttccctctgtgtctcaagtccacctttgcattgtcactttcttttctgaaatgaaaatggtattgtggctattacctagctagataccaactatgggctttgtagtatctggattagctgtaatgtacatgtgaatgatgactagtaaaatatatatagtaggaaaaatgatgcaattcaaaaagcaagaacacaagtataaataagcctaagaaggttggacatcatctatataaaggaaaataaactgtactccttagtgaagacttaatactgtaaaacctggccgggcacggtggctcacgcctgtaatcccagcactttgggaggccgaggcgggcagatcatgtcaggagatcgagaccaacctggctgacatggtgaaaccccgtctctactaaaaatataaaaaaattagccgggcatggtagcgggtgcctgtagtcccagctactcgggaggctgaggcaggagaatggcatgaacccaggaggcagagcttgcagtgagccgagatcacgccactgcactctagcctgggcaagagcgagactccgtctcaaaaaaaaaaaaaccgaaattgtccctaagcctaattgatagatttaaggcaatttaaccaatatgctaaatgggatcaggggcctatagtacaattatacttcattttaattggcagaaaaaatatatgaacaactaagagtatttggtggatagaggtaacatgggaagactcatcttacaagatattagagggcattataaactaaagtaaataatgtggcatagagcagaattagatcactgaaacaaaaaaatccagaatcagaatatatggaatgtggagtcctgataagtaagcaacaagaaggaaggggtcccaggtgagagagaacaattgttctatagatggctaattgcagacaacctgctggcacacatcctgttcccagataccttgttttgcatgtggcctttccagcacaaccttataaaacttaaaacctccagcccctgcctctcagacagcctcttctctgctgtgctgcccattgaacccttacaacgtatcttcaaactttctctgataaatctgcctttctttacctatgactgttttggcaaaattcctttactgtccacaacaccatccccactcagttgtacccaagacagggaagactaaatgtctgacgtttaccttaaaaagtatgaaaaaataagttgagaggggccaagcatggtggctcacgcctataatcccaacactttgggaggctgaggtgggaggatggcttgaacctaggagtttgagaccagcctgggcaacatagtaagacctcatcactaccaaaaaaaaaaaaaaaaatctgggcatggtggtgtgtgcctgtagtcccagctacttaggaagctaaggtgggagagtcacttgagcgccagagctttgaggctgcagtgaggcttgatcatgccactgcactccagcctgggcaacagggtgagaccctgctgcaaaaaaaaattattataa

SEQ ID NO: 829 - DNA, 4538890 bp, Homo sapiens (residues 1-1,512,964 of 4,538,890)
  misc_feature (958203)..(1008202): n is a, c, g, or t
  misc_feature (1689175)..(1869174): n is a, c, g, or t
  misc_feature (4240901)..(4290900): n is a, c, g, or t
gtgtcttcaatctcctgaagtcttacatgcttgacattgtattttcctctgtaagtaacctgctatttctctccgatcattttaaaatattttttccttgtctttcacaattttacatttcactgttcctgtgtgtgtactataatacctttaaatcttaagtcatttttttaaatctgaggaattctcattgattacttatttaagtacactctcctttttaatgactatattctcttcttataaggctactattagatgtgttttgacatttattcttctatcctccctattaattaacttttctttcatttacttcttctctatccattaccgattactttcatgaattctttagacgcatttcctcagctcagtaattgctttttcaactctatcagttttaatatccaatctattccaccaaataatttatttgagcagttaatgttttcatatccaatctatccaatagtttttctttttatttatttatttatttattcatttattcgtttgagatagagtcttgctctgtcacccaggctggagtgcagtggcaccatcttggctcactgaacctctgcctcccgagtccaagcaattctcctgcctcagcctcttgagtagctggaaccacaggcatgtgacactatgccaggttaatttttgtatttttagtacagacggggttgcaccttgttggccaggctgatctcgaactcctgacctcaggtgatccacccgcctcagcctcccaaagtgctgggattacaggcgtgagccaccgcacctggcctttttttctttatttatttttacacagagtttcactcttgttggctaggctggagtgcaatggtgtgatctcggctcactgcaacctccgcctcccaggttcaagtgattctcctgccccagcctcctgagtagctggagttacaggtgtgcaccaccacgcccaactacttttatatttttagtagagatggggtttcaccatgttggccaggctggtcttaaactgctgacctcaggtgatcctcccaccacagccttccaaaatgctgggattataggtgtgagccaccctgcctgggctgtcagatagtttttctatataaccctttcttcctgggaagatgtgtaagcccagacactccatgtgagttttagggtttctggattgataggtcgtaggatagggagcctctagagctgagctgagccaattctttccagtccctagcctatgagcccccagagacccttacaggatttctgccttacagcgtggagggggtctacgggtgagtgataccggttgtaattgcgtagctcagagggcagagggagaagtaggaaaggaatgctcagttactgaccagctttgatgagtctgcactttttctaggagctttccaagccccttattctttaatgttatcaggccactttgggctagcactgggccagccctgccaagtttctgctctgtatgtttacagaacaggtaataagccttctagaaaataaggagaaaaaaagaatgcaacttagaaagctccgcctgggctgattctccatctgtggcctctgacctttcccactctaagccatctcatcccccagtggggctaaaccatcaagggttttgttactgggaactgttctgaactccaaccacttcccacctcttctgtggcatctgcagggttgggtttgggaaagaagccagcagctattcctggttcaccatcttcttcttgaaccagatatgcctttacattttaaaagtaatttgaagtcattactaacaacacctaaaagatatatactaacttaaccacatgacaggcgctattctaagtgctttacacgtacttacccatttaatcatagcaatcaagtgagttagatagtgtggttatccccagtttactcttgagtagcctgaaacacggaaaggttatatgagttacacaaggtcacataccttaataagttgagaagccagaaactgaacccaagctgtctggctccagagtttgcactctaaaatactagcgttaagtgggcacagtgactcactcctataatcccaccactttgagaggctgaggtgggaggattgcttgaggataagagttcaagatcatcctgggcaacataggaaaacactctctctaccaaaaaaacaaatttttaattagccagccttggtggtgcacgcctgtagtcccagctacatgggaggttgagacaggaggatcacttgagctgaagaggctggggctacagtgagccatgattgtgctatggaactctagcctgggcaacagagtgaggccgtctctaaaataaaacaaaataaaatgctaatgcttttagccactctaccattctatcattcattagtgtcggtatccattccttgaacaacaaaagaacttctctttttttttcctgtccctcgtcccatcttccatgtttataatactgggaattttatttcaagactataattttttaagtttacaatcaaaagtttacactgtttaataaattttactatttttcttctaacaattgcttattgaaatcaccttcctcttaaatttacttttcttttctcatagggctgtataccaataattatttctgaagggtatatgtgtcattaattttctgaactattttttccctcattgtggattatcctggctgtatacagatatctaggttcaactttttttgtttgtttgtttttgttttgttttgttgttctgagacagtgcctggctctgtcacccaggctggaatgcagtggcaccatctcagctcatggcaatctccacctcctggactcagagattctcctgcctcagccttccaagtagctgggactgcaggcacgtggcaccacacctagctacttgttgtattttttgtacagatgggtttcgccgtgttggccaggctggtctcaaactcctgagctcaagcaatcctcccgtctcagcttcccaaagtgctgagactacaggcgtgagctactgcacctggcccaaacttatttttaatcagctccttgaaaaacttctccattgcattctctcttctctctttctctctgggacctttcaggattttatctctatcctagaaattttactccaagggtgtgtgtgtgtgtgcgtgcacgcaggtgtgtgtgcacatgtgtgttaggctcagaactagatggctcttttcagtttgaagattcatgtctttgttcagttcagaaaattctagaatgttatttctttaagtagtgccttctctccagtctttctattgttttgttgttgttgttgttactttttttttcatttttgacggagttttgctgtgacacccaggttgaagtacagcggcaggacctcagctcactgcaacctccgcttcctgggttcaagtgattcttctgcctcagcctcccacatggctgagatttcaggcacctaccaccacacctggctaatttttgtatttttagtagagacagggtttcaccatgttggacatgttttagatcatagttatcagcagcataataataaaatgaggctatcattgtacagagatgttaaagaattttcctggggcacagtggcagtggtagtctaatccagagctccaagccatttaaagctcattcacgtttgcatttgtttatgaagttcagatgttgctcactagggcttcaccccatagggcctcctggtgcttccgttgagacacccactctcgcaacaggaaggaccagctggcctctgctctgttaccggggccactcacatggcttaggaatcgctttgactgttggcccctccctactgtgagctccttgatggccttgtgtgcacctggggcatctgagaagccccagtcccagcccaggggatcctcggaggcccctgaatgagtgaccccacaagtgcagattcaactctggtttagagggtaaagggatctgggattgggttgccagtatggaggccaaattcaaagaaggatcatgaaaggtattaattgttattattactacacataaacagtgtttacaagctcagagaggactttcccttagcctattttacatgtattattcactatttcataagtgaggaagctgaataaaaagtagcttaagggccgggcgcggtgtctcacaactgtaatcccagcactttgggaggctgaggtgggcagatcacgaggtcaagagatcgagaccatcctgcccaacatggtgaaacctcgtctctactaaaaatacaaaacttagcctggcgtggcagcacctgcctgtagtcccaggtactctggagactgaggcagaagaatcacttaaatacaggagtcggatgttgcagtgagccaagatcgtgccactgcactccagcctggcgacagagcaagactccatctcaaaaaagaagaaaaaaaaaaaaaaactagcttaagattgttggtcagtgacatatcccaatgcaaccagaattggtatgggtaccatctcacttaattccacattcaatgttgatgcctcggtagggtggtatgccagatctggtactgctttctttgctgcctagtttaatttcagcaaaccatttctttacctctcccatccctgtattcatctccccacaccatctttccccacagtgttttctcccctccctatgtttttacatttattctcccagcagctgtctacaagcttatatgggatcccacaaaacgatgggaaacagctgtgcccccaggaaaaccaagtacccctgagaagattaacaagacatctggtaagagcaaacagtttgggaacaacccctctggcttccctggctatgttcaggtgtgtggactgggtgtgtggcatggaccccagacaagcctgggtccagcctgggctgaggagcttgctcagctccagatgagatgttagacttgacttccagagacacagggtggagttgtcatccatataaaaaaccacgtgacaggggagaggttccaagatggccaaataggaacagctccagtctagagctcccagcatgaatgacgcatttctgcatttccaacagaggtaccgggttcatctcattgggaatggttggaccgtgggtgcagcccatggagtatgacccgaagcagggcggggtatcgcctcaccggggaagtgcaaggggttggggaattccctttcctagccaagggaagccgtgacagatggcacctggaaaatcgggacactcccgccctaatactgtgcttttccagtggtcttagcaaacggcacaccaggagagtatatcctgcgcctggctcggagtgacccatgcccacggagcctcactcactgctagcacagcagtctgagatcgaactgcaaggcggcagtgaagctgggggaggggcgcccgccattgctgaggcttgagtaggtaaacaaagtggccaggaagcttgaactgggtggagcccaccgcagctcaaggaagcctgcctgcctctgtagactccacctctgggggcagggcatagcggaacaaaaggcagcagaaacttctgcagacttaagcgtccctgtctgacagctttgaagagagtagtggttctcctagcacagagtttgagatctgagaacagtcagactgcctcctcaagtgggtctttgatccccgagtagcctaactgggagacacctcccagtaggggccaactgacacctcatacagctgggtgcccctctgagacgaagcttccagaggaaggatcaggctgcaacatttgctgttctgcaatatttgctgttctgcagcctctgctggtgatacccaggaaaacagggtctggagtggacctccagcaaactccaacagacctgcagctgagggtcctgactgttagaatgaaaactaacaaacagaaaggacaaccacaccaaaaccccatctgtacatcaccatcaaaaaagaccaaaggtagataaaaccacaaagatgggaagaaaccagagcagaaaaactgaaaattctaaaaaccagagtgcctcttctcctccaaaggaacgcagctccttgccagcaacggaacaaagctggatggagactttgatgagttgagagaagaaggcttcagacaatcggtaataacaaacctctctgagctaaaggaggatgttcaaactcatcgcaaagaagctaaaaaccttgaaaaaacattagacgaatggctaactagaataaacagcatagagaagaccttaaatgatatgatggagctgtaaaccacagcacgagaactacgtgatgcatgcagaagcctcaggagccaattcgatcaagtggaagaaagggtatcagtgattgaagatcaaatgaatgaaatgaagtgagaagagaaggttagagaaaaaagagtaaaaagaaatgaacaaagcctccaagaaatatgggactatgtgaaaagaccaaatctatgtctgattggtatacctgaaagtgacagggagaatggaaccaagttggaaaacactctgcaggatattatccaggagaacttctccaacctagcaaggcaggccagcattcaaattcagaaaacacagagaacaccacaaagatactcctcgagaagagcaactccaagacacataattgtcagattcaccaaagttgaaatgaaagaaaaaatgttaagggcagccagagagaaaggtcaggttacccacaaagggaagcccatcagactaacagcggatctctcggcagaaactctacaagccagaagagagtgggggccaatattcaacattcttaaagaaaagaattttcaacccagaatttcatatccagccaaactaaccttcataagcaaaaggagaaataaaatcctttacagacaaacaaatgctgagagattttgtcaccaccaggcctgccttataagaactcctgaaggaagcactaaacatggaaaggaacaaccagtaccagccactgcaaaaacatgccaaagtgtaaagaccatcgatgctaggaagaaactgcatcaactaacgagcaaaataaccagctaacatcataatgacaggatcgaattcacacataacaatattaaccttaaatgtaaatgggctaaatgctccaattaaaagacacagactggcaaattggataaagagtcaagacccatcagtgtgctgtattcaggagacccatttcacttgcagagacacacataggctcaaaataaagggatggaggaagatctaccaagcaaatggaaaacaaaaaaaggcaggggttgcaatcctagtctctgataaaaaagactttaaaccaacaaagatcaaaagagacaaagaaggctattacataatggtaaagggatcaattcaacaagaagagctaactatcctaaatatatatgcatccaatacaggagcacccagattcataaagcaagtccttagagacctacgaagagacttagactcccacacaataataatgggagactttaacaccccactgtcaacattagacagatcaatgagacggaaagttaacaaggatatccagaaattgaactcagctctgcaccaagtggacctaatagacatctacagaactctccaccccacatcaacagaatatacattcttctccgcaccacattgaacttttgccgaaattgaccacatagttggaagtaaagcactcctcagcaaatgtaaaagaacagaaattataacaaactgtctctcagaccacactgcaatcaaactagaactcaggattaagaaactcactcaaaaccgctcaattacatggaaactgaacaacctgctcctgaatgactactgggtacataacgaaatgaaggcagaaataaagatgttctttgaaaccaatgagaacaaagatacaacataccagaatctctggaacacatataaagcagtgtgtaaagggaaatttatagcactaaatgctcacaagagaaagcaggaaagatctaaaattgacaccctaacatcacaattaaaagaactagagaagcaagagcaaacacattcaaaagctagcagaaggcaagaaataactaagatcagagcagaactgaaggagttagagacacaaaaaagccttcaaaaaatcaatgaacccaggagcttgttttttgaaaagatcaacaaaattgatagaccgctagcaagactaataaagaagaaaagagagaagaatcaaacagacgcaataaaaaatgagaaaggggatatcaccaccgatcccacagaaatacaaactaccatcagagaatactataaacacctctatgcaaataaactagaaaatctagaagaaatggataaattcctggacacatacaccctcccaaggctaaaccaggaagaagttgaatccctgaatagaccaataacaggctctgaaattcaggcaataattaatagcctagcaaccaaaaaaagtccaggaccagatggattcacagccaaattctaccagaggtacaaagaggagctggtaccattccttctgaaactattccaatcaatagaaaaagagggaatcctccctaacttattttatgaggccagcatcatcctgataccaaagcctggcagagacacaacaaaaaaagaacattttagacccatagccctgatgaacatcgatgcaaaaatcctcaataacatactggcaaaccgaatccagcagcacatcaaaaagcttatccaccatgctcaaattggcttcatccctgggatgcaaggctggttcaacatatgcaaatcaataaacgtaatccatcacataaacagaaccaaagacaaaaaccaaataattatctcactagatgtagaaaaggccttcaacaaaattcaacagcctttcatgctaaaaactctcaataaactaggtattgatgggatgtatctcaaaataataagagctatttatgacaaacccacagccaatatcatactgaatgggcaaaaactggaagcattccctttgaaaactggcacaaaacacggatgctctctctcaccactcctattcaacatagtattggaagttctggccagggcaatcaggcaagagaaagaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaaggaatgtgaaggacctcttcaaggagaactacaaaccactgctcaatgaaataaaagaggacacaaacaaatggaagaacattccatgctaatggataggaagaatcaatatcgtgaaaatggccatactgcccaaggtaatttatagattcaatgccatccttatcaagctaccaatgactttcctcacagaattggaaaaaactactttaaagttcatgtggaaccaaaaaatagcctgcattgccaagacaatcctaagccaaaagaacaaagctggagacatcatgctacctaacttcaaactatactacaaggctatagtaaccaaaacagcatggtactggtaccaaaacagagatatagaccaatggaacagaacagagtcctcagaaataatgccacatatctacaaccatctgatctttgacaaacctgacaaaaacaaacaatggggaaaggattccctatttaataaatggtgctgggaaaactggctagccatatgtagaaagctgaaactggatcccttccttacaccttatacaaaaattaattcaagatggattaaagacttcaacgttagacctaaaaccataaaaaccctagaagaaaacctaggcaataccattcaggacacaggcattggcaaggacttcaagactaaaacaccaaaagcaatggcaacaaaagccaaaattgacaaatgggatctaattaaactaaagagcttctgcacagcaaaagaaactgccatcagagtgaataggcaacctacagattaggagaaaatttttgcaatctacccatctgacacttttacactgttggtgggactgtaaactagttcaaccattgtggaagccagtgtggggattcctcaaggatctagaactagaaacatcatttgacccagccatcccattactgggtatatacccaaaggactataaatcatgctgctataaagacacatgcacacatatgtttgttgcggcactattcacaatagcaaagacttggaaccaacccaaatgtccatcaatgatagactggattaagaaaatgtggcacatctacaccatggaatactatgcagccataagaaaggatgagttcatgtcctttgtagggacatggatgaagctggaaaccatcattctgagcaaactatcgcaaggacagaaaaccaaacacctcatattctcactcataggtgggaattgaacaatgagaacacttggacacagggtggggaacatcacacactggtgcctgtcatggggtcgggggaggggggagggatagcattaggagatatacctaatgtaaatgacgagttaatgggtgcagcacaccaacatggcacatgtatatatatgtaacaaacctgcacgttgtgaccatgtaccctagaacttaaagtgtaatttaaaaaaaaaacatgtgacttggggcaagtctcccaaatttcctcagctgcagattcctagtccataagatggaaataaagaatcatagttcataaattgtttggaagcattaaatttaatctagaaggcctgatgacatgaaaggtgctcaagcaattctatctgtgataacctgggatcatatcttactcagctcaatgcctgatacccaatacacgtgtacttcagagatattgcaggttcagttccagaccactgcaataaagtgagtcacacacattgttttttgtttgacagtgcataaaacattatgtttacgctacagtgtagtctactaagtgtgcaatagtgttatgtctaaaaatatatataccttaattttaaaataattcattgtcaataatgctaacaatcttctgagccttcagtgagtcacactctttttgctggtggaggatcttgccttggtgttgatggctgctggcttatcaaggtggtggttgctgaagggtggagtggctgtggcagtttcataaaagaagacaacaatgaaatttgccacatcaattagctctccctttcatgaaggatttctctgtagtatgtgatgctattggatagcattttacccacagtagaacttctttcaaagttggagtcaatcctctctagctatgaaagtcctagatggcatctccttccaatagaaggttattttatctacattgaaaatctgttgtttcgtgtagccaccttcatcagtgaccttagctagatcttctggataacttgctgcagcttctccatcagggtttgctgcttcgccttgcatttttatgttatagagacggcttctttccttaaacctcacgaaccaacctctactagcttcacacgtttcttctgcagcttcttcaactctctcagctttcatggacttgaagagagttctggtcttgctctgaattagactttggcttaagggaatgttgtggctggtgtcatgttttatcctgaccactcaaactttctctatttgagcagtaaggcagttttgctttcttattcgtgtgttcactggagtattagtattattatttccttcaagaacttttcctttacattatatactattatttccttcaagaacttttcctttgcattcacagcttggctgtttggtgcaagcggcctagctttcatcctgtcttggctttcagcatgcttcctcactaagcttagccatttctagcttctgatttaaagtgagagacatgtgactcctcctttcatttgaacacttagcggccattgtagggttcttaatcgtcctaatttcagtgttgctgtgtctcaggaaatagggaggcccaagaaaaggaggagagatggggaagagctcatcggtggagcagtcagaacacacacaacattaatcgattaagtttgtcatcttctatgggtgcagttcatggtacccccaaaacaattacacataacagggtgattatagtcaataataacttaattgtgtgtttaaaaagaactgatagaatgtaattggattgtttgtaacacaaggataaatggctgaggggatggataccctattttccacgatgtgattactacgcatttgcatgcctgtatcaaaacatctcacgtaccccataagaatatacacctactgcgtacccacaaaataaagaacaaaaattattttaaaagactaaaaaacaacaaaaacaattgcagtaataatgtcaaagctcactgatcacagatcaccataacagacataataataatggaaaagtataaaattggtgagaatttccaaaaaaaattgcagcatctgtgaagcactgtaaaaatgaggagcaataaaacaaagtgtgcctgtgtgcccttaacaaatgcttgctgaatgaaaggaggtatcggtgaatgttcccgtaagtgaagaggttgggaatctaaacctcacaatggaaggagccagaagctaaaattttagtttgcatttggcctgtattggtgtggatctaaggtctcagcctctctaagccagagaatgtgaaaaactggataaagaaggcccatgggcacttgggagggggtaggcatctccttttttggagaaaacagagcctaacactctccaacctacccaaccctcatcttccaactattcatcataggacccaaaaggcggaaacatgactggacccacagactgcgtgagagaaagcagctggtgatttatgaagagatcagcgaccctgaggaagatgacgagtaactccataagtgaatcttcggctcacccctcacatccctgcagatgtgctattctgttatgatactggtatcccatcttctcacttgttccccaaaccattcccttctcataattttctagggtacagcattgaggctgaatgatgagatttcccatgctctttcgtattttttttttttttgagatggagtctctctttgtcacccaggtgcgatctcggctcactgcaagctccacctcctgggttcacgccattctgcctcagcctccccagtagctgggactacaggggcctgccactacgcccagctaatttttttgtatttttagtagagacggggtttccccatgttagccaggatggtctcgatctcctgacctcgtgatcggcccacctcggccacccaaagtgctgggattacaggcatgagccactgcgcccggccgatttcgcattctctttttactccctggcctgtaggtccagggatgctccctacccaggatgctgtgggctcccaaaccccaggtcagccctgatatgcaggccgcaccttcctctagcctaggaattgatagcctaggcgaggaagtcactgtggcatgaacagatggttcacttcgaggaaccgtggaaggtgtgtgcaggtcctgagatagggcagaatcggagtgggcagggtctgcaggtcaggaggagttgagattgagttgtcacgtggtgggaactcactgccacttactttccttccctcttcttgcctcagcctcagggaatatgacacatgcccatgatgagaagcagaacgtggtgacctttcacgaacatgggcatggctgcggacccctcgtcatcaggtgcatagcaagtgaaagcaagtgttcacaacagtgaaaagttgagcatcatttttcttagtgtgccaagagttcgatattggcgtttccgttgtattttcttgcagtgtgccattctgttagacattagcgttttcttttgatgagcaagacatgcttaatgcatatttcggcttgtgtatccatgcacctacctcagaaaacaagtattgtcaggtattctctccatagaacagcactaccctcctctctccccagatgtgactactgagatcaggtctgagtgtttaatttctgattttttcctctgcatttacacacacacctcacatgcacacacacacaccgagtaccagtataagtatctcccatctgcttttctccattgccacgtgtcctggtcaagcccccctcactctgtttcctgttcagcatgtactcccctcatccaattcccctgtatcagtcactgccagttaataaacctttgcaaacgttccccagttgtttgctcctctcattattgtccacacagctctgtgcacgtgtgtgaatatttctttaggaaagattcttagaagtggaattgatgtgtcaaaggagtcatttattcaacaaaaccctaatgagtgtgtcctcgtgctgagcgctattctaggtgctggagagacatcagggaacaaggcagacagatgttcctgaccaccattctagaggaggatgtttccagttgctgggtgtttgtttgtttcttctagagattgggtcgtgctctgtccaggctggagtgcagtggcatgatcatagctcaatgcagccttgaactcctgggctcaagcgatcctccctcttcagcctccggagtagctgtgactacaggcatgcaccatcacaccccactaacttttttaggtttgtcaagaaagtctcgctatgttacccaggctggtctcaaactcctgggctcaagcgatcctcccgccttggcctcctaaaatgcagggattacaggggtgagctgctgtgcctggcctccagtttttattttgatagagactatacacttcagtcctggagcaggattctgcagcatgtggttgggcatcttggccttcgctctctgaaccatttttgggttcaaggtctgggatggtccatttgggagtatgtgggaggagacacagatgaaatcgtcatctgggtaacgtggaggaatcaggcagatgtgtgcactgtagactctgtgatggccagggaatagaagagtccacttagtctccatgcaggggagcaacggtgggaaagtcccctggacagaagcatgagactgcccatcaagggtctcaccaaccaagggcctgggggctggggtggggacagtgatttgggaatgggacagttctttctcataggtaccattgcacggtgcagaggggaacatttctggggaagggaaaggcagaggggagtctattttaaaatcattgtgtgtgaatggagaccattaagactcacacctataatcccagcactttgggaggccaagactagcagatcacttgaggtcaggagttcaagaccagtctggccaacatggagaaaccacgtctccactaaaaatataaaaattagccgggtgtggtggctcacgcctgaaattccaggtactcaggaggctgaggcaggagaatcgcttgaatccaggaggcagaggttgcagtgaggcgagattaccccagtgcactccagcttgggcgacacaagtgagactccatctcaaaaatatatatacatatgcatatatatatatagctaagacactttttgaaaaagaagaataaggtgggaggaatggctctaccatatttcaatacttcttatatagctacaggaatcaagactgtgtcgtatggggcgaagaatagacacacagatcactggaacaaaatagagaacctagaaatagccccacactgactttttacaaagcgacaaaaagaaggaaggattgtctgctcaacaaatggtgctggagaagttgcagagccataagctaataaaaaaaagacctaatcttcatacctttatacaaaaaaaaaaaaactcaagtggatcatagatttaaatctaaaatataaaactaaaacagaaacttttacaagaaaacataggagaaacatctgagatctagggcatagtaaacagttcaaaaagcataatccataaggaaaaaaaattagatttcatccaatttaaaacttttgccctgcaagaaaccctgttaaaaggatgaaaaaacagggtatggaatgggagagaatgtttgcaaaccacatatccaagaaaggactcacatccagaatgtataatggatatgtatagtactctcaaaactcaacagtaggccatggctcacgcttgtaatcccagcactttgaaaggttgaggtggatggagggcagatcccttgagggcaggagtttgagatcagcctgagcaacatggcaaaaacccatctctactaaaaatacaaaaattgacaggcatgatggttcacgcctgtaatcccagctacttgggaggctgaggcatgagaatcgcttgaacctgggaggcggaggttggagtgagccaagatcatgccactgcactccagcctgagtaacagagcgagaggctctctcaaaaacaaacaacaacaacaaaaaactcaacggcaaaaaacaaacaaataatccaattagaaaatgatcaaaatatatgaacatacatttcactgaagaggaaataagcaaataagctcatgaaaagatgttcaacactaatttgcttcactagatgcaaattaagaccatgatgaggtatcactacacacttattacaacagctaaaataaaagacatagtgacaacacgaaatggtgacaaagatgcagagaaattggacaccttgtaaaatgctgctgggaaggtaaaatcttacagccactatggaaaactgtttgatagtgtcttataaaactaaacatgcaatgagcacacaattcaacaattacacttcagagaaattaaaatttatgcccatccagaaacttatacataattgttcatagcagctttacttgtaatcgccagaagctcgaaataatcaatatgtccaacaataagtgaatggtcaaactgtggtacatccataccacgaattactactcaccaataaaaatgaactattgatacataaatattaatgccttgaatgaatctccagggaattatgctgagtgaaataagcccctaaaatgttatatactataagatttcatttgcacagcattgtagaaaagacaaaattgtagaaatgaaaaacagatttgtggttgccagggattagggatggtggatgggaggacagtattaccaaaaatgagtagcacaagggatagcattgtggtgatgaaaatggtttgtaacttttttttgagacagagtcttgctctgtctcccaggctggagtgcagtggcatgacctctgctcactgcaacctctgcctctcgggttcaagtggttctcttgtctcagcctcccatgtagctgggattataagcacgtgccaccatgcctggctaatttttgtatttttagtagagacagggtttctccatgttggcccggctggtcccaaactcctgatctcaagtgatctgcctgcctcagcctcccaacgtgctgggattacagagatgaaccactgcacccagccatgttctgtatcttttttttttctgaaatataagctttattttaaattcaaagaaatattaaactttcttttacaaattataatcaaacactcaaacaatttaggaattttaaacactaattcttaattgaaaataatgacatccatagaatacatcctgatgttggccaacatgaagtttacttaatattagtattttatatatgcttaaccattcatccttcctaaaattcaatgataacaaagatttgactttataaggtgaagccttttatgtaatatgctagagataactttttcaaatacaaaacatttataccagcaaggaaattatgaaagcatatataaattatactgaaggatgtgatttaaaggctgtctgtatacatagatgcatttcaccttagaaagtacatatgcacatcaaaacactttcattgaatatagatgccactacattctcttacttatattacaaaagcaaacggcaggttcataaacgttcttctattatgtatcaactgaaaaaaacatatatacacaaaaagattttgacggcacatgggagtggaatgtgcctacatttagagcagagcttttacaggaccacctgtctccagccggctcccagggaccattgaaaacagctgctaccctcagaatgataagatggccttgttaatgagttcactggactctcgaatctcatcctccttgaccaccagcagaggtgaaacctgatgatgtcgccacaggttggcttggccagaagtccataatcttgaagtcgtagacacaccttccaagcatcacaatctttggtttctttaataacaatagcgtttaataattcctttcctcgccgggcgcagtggctcatgcctgtaatcccaacactttgggaggccaaggcagctggatcacctgaggtcaggagttcgagaccagcttgaccaacatggcaaaactccatctctactaaaaatacaaaaattcgctgggcatagcagtgcgtgcctgtaatcccagctactcaggaggctgaggtaggagaatcacttgaacctgtgaggtggaggttgcattgagccgagattgcgccattacactccatcctgggcaaccagagtgaacctctgactcaaataaataaataaataaataaataaataaataaataattattttcctcttacggcagttacaacatcagaaggtagcttcatgggttcatttctcaagataatacccattttttttctgtattttcagcaaggttttcttcttctaaaacctcaagggctgcaattgtcacttggcagcctagtggattgccaccgtatgtggacccacattcccctggcttaatggtcagcattatgtcatcgtcccacagcactgcagacacagagtatcagcccccagaaagggcctttccaaggaggactatatcaggtctgacattttcatgatcaacagccagccatctaccagttctggcctatcctgactgtatttcatcagcaatatacagatcctggtgcctggtgcagagctctcgcactcccattaagtaacctggatctggaacaacacctgcttcaccctgaattggttctaccatgaatgcagccacatttggattctgaaaagcactctccagtgcaggcagatcattgcagggaatgacgtcgaagccaggcataaacggtccaaaaccatcataactcgtcaggtctgtggaactggagatagcagaaaacgtcctaccccaaaagtttccagctgcggaaataacctttgctttgtatttctgaatgcccttcacagtatagccccacttatgagctagtttacaggcagtctctccagcttccattcctgtattcataggaagaactttgtggtagttgaaaagtttagtaatatactcctcatattcaccaagtacgttattatagaaagctctagaggttaaggtcaatttcttcccttgactctttagtgcattcacaatcttggggtgacaatgcccttggttgacagcactgtaagaactcagaaagtcaaaatattttctgccttctacatcccataagtaaatacattttcctctctccagggctacaggtaaaggatggtaattgtgcgcaccacacttagattccctttcaaaaatgtagtcagaggttggagggccttggactgttttcttcgggttttttttgtttgtttgttttttgttttgagatggagttttgctcttgttgcccaggctggagtgcagtggcacaatctcggctcactgcaacctctgcctcccggtttcaagcaattctcctgcctcagcctcccaagtagctgggattacaggcatgcaccactgtgccgggctaattttgtatttttagtagagatggggtttctccatgttggccaggctggtctcgaactcccaacctcaggtgatccaccagccttggcctcccaaattgctgggattacaggcgtgagccaccacacccggtctggattttttttttttagttgcaacagatgtagcagaagccactgaagaatgagctccacgactaagtacagcaaacctctgcaaaggtgctagtttggaaaacattgtgtccttcaagtagaaaaaccacagatcgactatttttttcttcccatggttcagactagaatacagatttttaacccaagatccaaggatgatcttcagagagtccaaaatctcctgacagtgcctgaggaccacccgggacacacactgtctacaaagcacagccatgttctgtatcttgattacggtgttggttacaggagtctacacatgggataaaaaggcatacacactattgctccaatgtcaatttcctgattttgatattgtactatagtatttttacactactataatatagaggaaactcagtaaagggtatatgggacatatctgtactatttttgcaatttcccataaatctatattattcccaagtaaaaagggaaaaacatacaattttttttgagacagggtctcgccctgtcatccaggctggagtgcagtggggcaattatagctcactgcagcctcaaactcctgggctcaagcaatcctcctgcctcagcctcccaagtagctaggactacaggcacatgccaccatacccacctatttttttttttttagagatggggtcttactatattgcccaagctaaaaatacatttcttaatgaaagatcaggatgagaaacaacaggcttatctgaacacctgcacaataaccaaatacaacttctagaagtgaaaatggtgatttaaataattaataaacttattaaactgcagattagacacaaacgaagaaataattagcgaacgaaaatatagctctgaggaaaacacaacattagagataaagaaacagaaaataggccaggcatggtggctcaagcctgtaatcccagcactttgggaggctgaggcgggtggatcacctgaggtcaggcattcgagaccagcctgaccaacatggtgaaaccccatctctactaaaaatacaaaacttagccaggcatggtgatgcatgcctgtaatcccagttactcaggaggctgaggcacgagaattgtttgaacctgggaggtggaggttgcagtgagccgagattgtgtcattgcactccagcctggacaagagtgaaactccgtgtcaaaaaaaaaaaaaacaaaaaagaaatggaaaatataaagatatggaggatagaatgaaaagagctcacatacattgaacacaaattctagaaagggagaatagaaagatttatggagaacaatgttcaaaggaataatggctgagaattttccagctttggtaaaaagcatcaatgctccttatgtgagctcacccagacctattactttattatttaaggaattattcactaaaacacatgctgctttaatgtagtttaattataatccagtgttcataaagatgatgtcatttggaaaaatattgattgggagcatttggggatcataaatttgaagtggtactaaaatactaggccacattagaacatgtggaaaaagaaagaaaaagcaacaaaaataaagttctaggccacaacaacacaaacactgaaagagaaggagattagagttaaagtaatcaaaggacatgtgaaaatggaaactaaagttatcatcaaatttaaaccttttaatgtcaagtaatgatgtttaaaatgtttaatgttgctaacacaaagtaaatggtggaatagagaactccaaaaatctatgcctctataaaaatcagtgaaaaaactggcaaaaactgtcaggatcaactttttcagaactttgaaaactaaccgaaagcttgtaacaagcagaggaatgtttaatcaagaaaaaccagctgagtggctcacgcctgtaatccagcacttcgggaggccaaggcaggcagatcacctgaggtcaggagttcgagaccagcctggccaacatggtgaaaccccgtctctactaaaaatacaaaaattagccaggcgtggtggcacgtgcctgtaatctcagctactcaggaggctgagacacgagaattgcttgaacctgggaagtggaggttgcagtgagctgagatggcaccactgcactccagcctgggcaacagagcaagactgtcaaaaaagaaaaaggaagaaaaagaaggaaggaaggaaggaaggaaggaaggaaggaaggaaggaaggaaggaaggaaggaaggaaagaaggaaggaaggaaggaaagaaggaaggaaggaagaaagaaaggaaggaaggaaggagaaaaaccagctgaatctccataagaacagtaagctttgtggtattttaacttacccttgtcccatctcctgctcccagcttggtggtagccctgaagataatgatctgcattcccagtacaggtaccagtaccagagagaaaagaatggaccttattcacaaagaattacagttgtttgttttgacttgtctggtggttccctggaagaacccacttgaaaggcttgtcttcatttgacctcactcaaactgatgctacaacctggggtagtgaatagcagttgaggcaaacaatacatcaaccagcaagcttaaaaggaaaggctggaggccaggcatggtggctcatgcctgtaatcccagcactttgggaggctgaggcaggtggatcacgaggtcaagggatcgagaccatcctggccaacatggtctctactagacaccccatctctactaaaaatacaaaaattagctaggtgtggtggtgtgcacctgtaatcttagctactcaggaggctgaggcaggagaattgcttgaatccaggaggcagaggttgcagtgagccgagatcgcgtcactgcactccagcctggcaacagagcaagactctatctcaaaaaaaaaaaaaaaagaagaagaagaagaagaaggaaaggctggaaaatggggcttgaataactccaacacatgcctgggaatctagaaggccacacacatacgccctgggctgcagctaggcgaatgcccacagaagaactaagtaggctttaatctctcacctctgcagacctcgaggctctgagcaagcaggaagagaaagataaggcaacgttgtaaactgccaggctgagtgcagaaggtatgtcccaacacatacacaaatccccttggcaaagactgggagacatactggttccaggcatttaaagaaatttctgttcaatcattagtggccactaagctaaccaagagacttcagtggccacagaggacaaggaatagagactacagaatttgttcaggaaaaaaactagacaaacttgtgttttgagacagggtcttgctctgtctctcaggctggagtacagtggcactaacacggctcactgcagccttgatctcccaggctcaagcaatcctccagcatcagcctctgagtagctgggactataggcatgcgccaccacaccaagctaatttaatttatttatttatttatttattttttgagatggagtctcactctgtcgcccaggctggagtgcagtggtgcgatctcagctcactgcaagctccgcctcccgggttcacaccattctcctgtctcagcctcccgagtagctgggactgcaggggcccgccaccacgcctggctaatttttttgtatttttagtagagacggggtttcaccgtgttagccaggatggtctcaatctcctgacctcacgatccacctgcctcggcctcccaaaagtgctggggattacaggcgtgagccaccgcgctcggccaatttttttttcttttttaagagacggggtctcactatgttgcccgagctggtctcaaactcctaggctcaaatgatcctcctgccttggcctcccaaagtgcttggattacaggcatgagccaccgagctcagcctaaacaaacattgaaaacaaacaaacaaaacagcaacaagaaaccccagggaagggacagaatctggtttccagagttgccacattatattatttgaaatgtccagttttcaataaaaaattatgacacctgcaaagaaagaagaaaatacgacccatccacagaataaagaaaaaagaccacctatagaaaccatccctgagaaagcccagatgttgggttttccttttttcttaatgtattttattttatttatttatttattttgagacagagttttgctctgtcgccccggctggggtgcagtggtgcaatctcggctcactgcaacctctgcctcccagactcaagcaattctactgcctcagcctcccaagtagttgggactacaggcacccactaccacacctggctactttttgtatttttagtagagacagggtttcaccatattggccaggctggtcttgaactcctgacctcaagtgatccacctgccttgtcctcccaaagtgctgggattacaggtgtgagccaccacgcccagccagatgctgggttttctaataaaaagactttaaatgagctatttaaaatacgtccaaaaacctcaaagaaactatgtctaaagaactaaagtatagaaacaatatctcaccaaatagagagtatcaatacagacatagaaatataaaaaatgaaccatatagaaatttctggagtttaaaagtgtaataatcaaaatgaaaaattcatcttctgctgatgctaggagtagggacattgccctcatctctttttggggttctttctgttaaatatgaagacttgcttttttttctttttgagacaaggtctcactctgttgcccaggctggagtgagtggtgcaatcacagctcactgcagccctgaactcctaggttcaaacaactctcccacctcagcctccctgagtagctgggactgcaggtgcaaaccaccatgcccgactaattaaaaaaaaaaaattggggctgggcgcggtggctcacacctgtaatctcagcactttgggaggccaaggcaggcggatcacctgaggtcaggagtttgaaaccagcctggccaacatggtgaaaccctgtctctactaaaaatacaaaaattagctgggcacggtggcgcatgcctgtagtcccagctactcaggaggctgaaacaggaaaatcgcttgaacccgggaggcagaggttgcagtgtgccaaaatcgcgccattgcactccagcctgagcaacaaagcaagactctgtctctaaataaatagataaataaataaataaataataaataaataaataaatattgtgtagacacaggatctcactatgttgcccaggttggtctcaaattcctggcctcaagtcatcctccttagcctcccaaagtgcccagattataggcatgagtcaagacttgcagttttaaggccaggtgctggaatttcaggttaccattattatcaaaaagaatggtttgttgagcttaagtttagtggcagtaaagggagtggacaaagctatataagagcaatgttttgtatagtattgaaattaagttggtatcaatctgaactagattgctaaaaattaagatgttatttttaatccctagtatggtctgaatgtgtcccctccaaaactcaggtgttgtcaatgtgacagtattaagagatagggtctttaagaagtgactaggccatgaggggttctccctaatgagattaggtgtccttataaatgagatggagggagttgcttctctcatgtccttctgccttctgccatatgagaatgcagcaaaaagcgctgaccagatgctggtgccttgatcttggactttccagcctccagaactgtgagaaaataaatgtctgttctatacaaattacccagtctgaggtattctatcatagcggcaccaaaagactactaaaatcccctaagtaggacttgcatcccaaggaagtgtaagacttctgcactgaaaactacaaaacattgctgaaggaaattaaagacctaaataaatggaaagatagcccatttttcatggatcggaagatttaatgaagtactgatacatgctgtggcatgcataaaccttgaaaatatgctaagtgaaagaagccagacacaaaagaccacagtgtatgattccacttatatgaatgccaagaataggcaaatccgtagggacagaaagtagattcatggttcccaaaggctgggcggagtggggagttactattaatgggtatgaggtttctggtgggggggggttgttgttgttgttgtttgttttgtttttttgttttttttttttgtttttgaaacaaggtctcactctgttgcccaggctggagtgcaatggtccaatccagctcactgcagccttgaactccttagttcaagcaattctcccaccccagcctccctgagtagctgagactgcaggtgcacaccaccatgcccagctaattaaaaaaaaaacttagggacaggatctcattatgttgcccaggttggtctcaaattcctggcctcaagtcatcctcttgccttggcctcccaaagtgctgggattacaagcatgagtcatcgtgcccagccaagacttgcagtttgaaggccaggtgctggaatttcaggctaccgttattctcaaaaagaatggcttgttgagcttaagtttagtggcagtaagggataaagaacagtgaaacaaggagcatatagtattaatcaactacagacaactgccctatttgtaaatagaagcagggaaataatatatatgtgtagtagcttataaatgcgtaaaaattatctgggaggataagcaaatgtctctcaaacatctaaaagcttccttcaggctgggtgcggtgcttcatgcctataatctcagcaatttgggaggccgagatgggtggatcacttgagcccaggaattcgagaccagcttgggcaacatggtgagaccccgtctctacaaaaaaatacaaaaaaggccgggcgcagtggctcacacctgtaatcctagcactttgggaggctgaggcaggcggatcacgaggtcgggaggtggatcacgaggtcgggagatcgagaccatcctgactaacatggtgaaaccccgtttctactaaaaatacaaaaaattagccaggtgtggtggcacacatctgtagtcccagctactcgggaggctgaggcaagagaatcacttgaacccggggaacagaggttgcactgatccgagatcgtgccattgcactccagcctgggagacaagagcaagacttcatctaaaaaataaaataaaataaaataaaataaaataaaataagccgggtgtggtggcatatgcctgtggtcccagctacttgggaggctgaggtaagagaatcacttgaacccgggaagttgaggttgcagtgagctgtgatctcactactgtactccaggctggatgacagtgaaaccctgccaaaaaaaaaaaaaaaaaaaaccttatttcataaatacggctcatgcctgtaatccgagcactttgggaggccaaggtgggaggatcacttgagcccaagagtttgagaccagcctaggcaacatagagagatctcatttctactgaaaattttaaaaattatccaggcatagtggcgcatgcctgtagtcccagctactcagaaggctgaggcaggaggatagcttgagcctgggaggctaaagcttcagtgagccgtgatggcaccactgcactccagcctggatgacagagcaagaccctgtctcaaaaacagttaaaaattaaaaattaaagaattagaaatacacacacacacacacacacacacacacacacacgtatgtgaagtgtaatggcaataccattttttctatgaggttgacaaaaatctgttgcattgctcaggctgttgacaaggctgtggtgaaaatggcactcacatactcatgctagcttctccttgctcttgcttggaccagccatgctcgttcctacctcggggcccttgcacctgttgctccctctgcctggaacaccctttgccaaaataaccatgaggcttgctcctttcagccaacctaggaccaaattcattgccccctccttagtgaagtctcgctgaatgcctcctcacccaccacctccccacaccactctcacatcgctcattttcttcattgcaccatctttatgaggaatgatttctcttttattctctttgttaggtcagaggtcagctaacattttctgaaaagggccagagagttaatagctcaggctttgcaggccatatggtctctgttgcaaatcctcagctctgcacgagaaagccacaaacaatatgtaaatgaagaagacactgtaaatgatatgtaaataatttagacactgaaattgatatgtaaatgatttagacactgaaatttgaatttcacataatttccaagtgtcacagaatattatttcttttaataatattttttcattttcttttcttttttttgagacagaggctggagtgcagtggtgagatcttggctcactgcaacctctgactcccaagttcaagcgattctcctgcctcagcctcctgagtagctgggattacaggcgcgtgccaccatgcctggctgatttttgtatttttagtagaaacggggtttcaccacgttggccaggctggtctagaactccttacctcaggtgatctgcccgcgtcggcctcccaaagtgctaggattacaggcatgagccaccacacccagccccttttctttttgagacagggtctcactctgtcactcaggctagagtgcagtggcgtgatcatagctcactgcaccctcaatctcccgggctgaagcgatcctcccacctcagtctcccaagtagctgggactataggcttgcactatcacacccggctatttcttttaatattttttgtagagatggggtcttgccgtgttgcccaggctgctctcaaatgatcctcctgcctcagactcccaaagtgctggtgattacaggcataagccaccatgctggatccaccttttttcaatcatttagaaatatgaaagccagtcttagttcaagggccataccaaaataggcagcaggatggatttgcccactcgtgtgtcagaacatcaactccagggcactattgtctgcttggttcactgctatatccccagcacctagaatagtgcctggcacccagtaggctttcaggagatgtttaccgagtgaatgagtgaagtctttttctgtgtgtgagatggagtctcactctgtcgcccaggctggagtacagtggcacaatctcggctcactgcaacctccgcctcctgggttcaagcgattctcccgccttagcctcccaagtagctgggactatagcgtgcaccaccacacccagttaattttagtattttttagtagagacggggttttgccatggtggccaggctggtctcaaacttgtgatttcaagtgatccgccggcctcaacctcccaaagtgctgggattacaggcgtgagtcactgctcctggccaagtgggtgaaatattaagttgagtagcaagttactgaaagagtgaagtgaatgaatgcatgatcaggcacagtcccactcgcagggcttcagtttgctccagcctggactccggcaggctcccccagcaagactaagagaaagatcagaaggctgagtccagagtggtagctcaacatctttatttttcctctttagcccgagggtaatcctgacaaacagcttcagccaggaggaggcagagaggactgggctgggcaaaggctccaccaggacctggcctcctcctcctcctcctcctcctcctcctcctcctcctcttcttcctcctcctcctcctcccatggggttggggttgggattagggccatgatccaagcttggcatccctggggaggagggaagtgggccagtctgcagcctctgctgtcccccgcctctgacaaccacgttcatgggaaccagccacctccacatgttgggcaggagggaccctagggagcggccctgacccctccatgtgcatgcgcacagggacctgggccagcagggcctgatcagtgtccagacatgcggctctggcctgtggcccagttggcaaacataaagcctagactgacggccatgaagaggactcccaggactccaaagcacagggcctgtgggccagagagacaagatggggctggttgggactcctcacccagttgccttctgagaatgttcctcaagtcttccacctccttcagagagtgctccatccattcctgaccctcctctgtatgccctctccttccttacagccagcccctttctgcgagtccttccaccttcccaggacccatgacagaatacgttcctccatcctccttcttcaaagtgcttccagctctcttcccaatagtgctctttccatctgtctggagaatgctccctctatgccagcctctgtttgagtgctccctgtcttcctggaccctgctggtgctctgtctcctctgccccttcctagacaatcaccttcattcttccagaccattctttcagatgctctcccagccccctcctatgcatgtccctttcacctccagccatcctggagtgagcactccctccttggagtgctccctctctccctagctctgccctggaatgcttacctggatcttgggccaggataagaaaggctccacctcagagggtacaatgcggaggtagaagatgctggggaggatgaagatgaggctgggggctgaggtggaccctggagaacaagaagaagggacaggagtcaacctgacttggggacaaggcccatattagatggggtatgggactggggtgaggtttactgaccgataactccaaagatatcccggatggttggcacacagatgacaaggacattgaccaaaacaagcaggatcagagctatggccacatgtcgtggccagctgaaggccttgcctgggaaaagcagctgctgcagggcccggcggatctgtggccagagtagggtgggacagaagtcaggacccaagtgctgccccccttccacgtgatcatctgtctttagctccaccctctggctgagatccctgatttcccctccctctgactatctatggctccaccctgcctaacccaacatctgtgtctctatgttctgaacaggcttcctgcctccatcctctgacaatccacgtctcttccttctgtctgaacacccatcggcacctgcacccactgtctgaaatccttgcctcctcctctagctgaccatctttgccttctccttctgtctgaccatccaccgatccttccaccctgtgtgagctccctgcctctctccatctgacctctacctccctcctctgtctaattagttctgcctccccatctgggagacttgaccctcctacatcccatcacttcagcctccaccctttttctgtccatccctgtttcttaattctaccctccaactgacccttcctgcctccctcttctttctagccatccatctgtgcctcctccctccaactgactaccctgtcccctgaccctctctctcctgctatctatgtcctccccacttctgtttatcgatttttgccatctctgtccatctgaaaacactgccctttcctgtctgtccatccttgcctccttcatccatccatccactcctgtttccagccttgacccacacatccatgcctatgccctctacccatccatccatgtccctctcagccgtgggccccacgcacagggaacagcacgactggcacagtgagggtcaccgcgagcagcacggccaggcgcacacagaggatgagcgggtccttctggctgtacatgtgcagcatctccgccttcacactgcctgggccatgagacagagggtacgggatgcaggatgtggagagagcaccaggaccaatgccccagaaacccatacatacatgcacagtgacaaaatccacacaagtgaggcacaccttctgtttggaaactgacaggtccgtggtcacagaaggaaagagctcagaggctcctgccccaggccttccccctccccccagccctagccccagccccactcactgtagaaggtgaggtatccaaaggttgctgtgagcccatacatgcagaacatggccccaatggacacgttggccacggcctgcatcctgcgcttggagggcctgaggtgtagaggtcgtggaactgtcatgcccagaccctgagacttgccccaggtccctcaaagccagcctccaccctccagagtccccttctcccagactgccattcagctggcacacatggggacacccgtctctgcctcccctgtgactagccaaaatcccctctctgaccatccatatctcccccgatatgactgtctccctctcccctgcgtttgactgccactgcctcttccatctgaccatccatgctgtccctctgtctgatcatccacacatctcccatcatatcatccctgcctccgcctctgtctgtccgtacctccctatccccatatcaccagccatgcatatcaccccctccatctgatcatctgatctctgcttcccaactctgtccatccacatttgtgctggatattaaaataggagaatacttaagccccaatcagcaaacagtcactaccctgagtgccccaagacctcctggccaccccaaacccctcccatgacacaacctagcttccaccaagtgacagtcccaggactgctgtagggagtgtcagacattctggttaccaccccacttgctggcccatcattcaggcccacttgcctgcccactcaccggcagagctccgtatagatgggcagcacctcagggtggcagacaaaagcaaaagccataatgggcactgtgtaggacatctaggggaatgcccgagtacatgggattagagccaacaggggtccatccccttcttcccatccccctcccgccccgtaatcgccctccatatcagacacatagaagctcccaatgtccaatatccagctccactctgagcaggatgcaccatatgacagaaccagagggcctgagtgtgatgcaatctcctacatgcctgcacacacacctgtgagtcaactgtgaacatctgggcctcacagctgctgttgagtccttggctggggagtcccacgagagcttcactctccattgctgtttcattgtggcctatagcacagccaagttggaacttcttgtagatgacctgaggatgggggcagcagggaagccaggtcatggaggaagctatgtcccaatgtcccaaactctctccccgcttctctgtgactcaccgaaacaaggaaaaacagcatgcaggtcagagagagaccactggtgtaccccaggtagcctaagaggggcaaaacacagagtctcagaaatcagccaggcgtggtggctcacacctataatcctagcgctttgggaggcctaagcgggtggatcacctgaggtcaggagttcgagaccagcctggccaacatggcaaagccccatctctactaaaaatacaaaaattagctgggtgtggtggcgcatacacctgtaatcccagctactcgggaggctgaggcaggagaatcgcttgaaccgggaggcagaggttgcagtgagccaagaccacgccattgcaccactccagcctgggtgacagagtgagactcggtctcaaaaaaacaaaacaaaacaaaaaatcaatggacccccggaacagtgaactccaaacacctagtctagccttcaaggtctacccaccccagttacctttgcataagcttctacttccacccagaaaaacctcccctccatagcaaactcctactaatctgttcaagcccacatcaaataagctctctcctagtgtgctgcagcccttgaaaatgaatgggggttttctcagtctggcttcttctgtctaatcccactacccaatggccaacccagggagcctcttacccaagtgtttcatgagggcgaggggcaggatgattaacacactgacgatgatgatgaggaggtttcccttcaagaaccagtccctagagagacaggaagacacagtgcctagctgccagccaaaggaaactgtcaggcagacactcacagaagacagctggacaggcagctttctgccctaagtcaggagagttaagctgacaacctcagcttgagaagtcattcaggtggtcacagtgacaaacggcacaatagggttgacaaaaacagtcaagctgattatgagattgtcagatactatcagtgggacacagctaacacatacacagctggacaaaacttgccatcagacttcgcaagtggttgcacaaccagaaggtcaaacaccccaaatcagtcagactcaatgtaaaaatcagtccaggccaggtgtggtggctcacgcctgtaatcccagcactttgggaggctgaggcgggtggatcacctaaggtcaggagtttgagaccagcctggccaacatggtgaaaccctgtctctactaaaaatacaaaacaaattagccaggcgtggtggggagtgcctgtagtcccagctactcaggaggctaaggcaggagaatggcatgaacccgggaggtggagcttgcagtgagccgagatcacgccactgcactccagcctgggcgacaaagggagactctgtctcaaaaaaataaataaatagataaatagccaggtatggtggcgcgtgcctgtaatcccagctactcgcgaggctgaggcaggagaatcacttgaacccaggaggcagaggttgcagtgagccaagatcgcgccattgcactccagcctgggtgacagatcaagacactcaaaaaaaaaaaaaaaaaggaagaaagaaagaaaaaaaagaaggaagggaggaaagaaagagaaaggaagaaagaaagagagagaaagaaagaaagaaagaaagaaagaaagaaagaaagaaagaaagaaagaaagaaagagaaagaaagaaaggagaaaatcagtgcaacacaaggtgccagacacaaagagagtgagtcacgatcgtggtatgtctgacaggtagagcaacagtctgatgatccagtagacaagccacgatgcagagtccatcaaaaagtcagaaacacacatgcatgcttgtttgaacagctcaaggtttgttggatgcctgaaagtatgcctgtggactgatttggctgcacagccaaagaaagactgaaatagaaacgaaatcatccagctggccacactgttggaaccaagctctgagaaaaggtgggatctgtacagatattggaggaaggtgaccaggcaagacagtcagttaagacagaatcagctgaacaactgctcatgcattcaaaacaacttgattgaatgcctatgttctagacattcacatggtctctttctatctcatatacagttacacagaaataaaccaatgggagctaactataataatgagacatctctggtcacactatcagctatctagtgttctcagaatcaaaccaaaaatctaaaaggatacacacagagagtaaagatcaagcactcagttaaaattgtcagactggccgggtgtggtggctcatgcctataatcccagcactttgggaggccaaggcaagcagatcacctgaggtcaggagttcaagaccagcctggccaacatggcaaaaccccgtctctactaaaaatacaaaaattagccgagcatgggggctgaggcagaaggatggcttgaacctgggaggtggaggttgcagtgagccaagatggcgccactgcactccagcctgggcaacagagtaagactctgtctcaaaaaaataaaattaaaaaattaaccgagcatggtggtgcatgcctgtaatcccacctactcaggaggctgaggaaggagaatcgcttgaacctgggaggcagaggttacagtgagctgagatcgtgtcactgcactccagcctgggcgacagaatgagactctgtcaaaaaaaaaaaaaaactgtcacacagaccagagtcagactgacaaaaccagagacacatctacacaccatgcaaagcccatgggaccagaggcagagttagcccatgggaccagaggcagagttagccactggacacacagagctgttcatgaaacacacagaggcagctacacacgtgcagctggagcacaagcactgcaacacactgtgcatacacactagccctgctggagtcccatcgtgcacatgccccccacacataccaagccagcacagcggatccggactcacacacagtcagccagatgcataatcagaacagtccagcatatatggttgcaaccataatacagaggacacatagccacattcagggatcacacacacacacacacacacacacaccagagagaatttgccagaacagccaccaaatcaaacacagagatggagttggctggacacgtacagtcagagtgagtcacacatagttggtaccacagcatactacgtgcacacagacacactgctggagtcagcgatcacacactcacagctagacggagtcagtgatcacacactcacagctagacagattcagccagatgaacctagaatcaagctcaaacaatcagctggacaggggaagtcagagtgaccgagggtaagacacatatggttggaatcccagtatacgggacacagctgtagtcaatcacagagctagcccaagagaatcagccaggacagcagacgcagagtcaaacccacaggcagagtctgagtccattggctatgtacattcacacacacatggtcagcagcagagtaaaccggacataaagagtcagcctccagccagaagcagccagaataagtcacaaaatcagcacacggtcgactggactcctgtggtcagagcaacaggcacacagaggaatcagtctgacccaagtggcctgcccagcagtctcaaactagaacatctggaagtcagctgcacacacagcgctgaagatactgaccgggcctcacaggcagagtcaaggggctgctggccagccaaggggtgttgctcactcacccctcggggtccatgtacaggaaggtgccgataaccagggggagctcagatttgatgatgaacaggtaactggacatggctggtgcaggtgggggaggtgtaagcagaaggattctcttcatgcccccaccccgtcttccccagcccagcctggggaagcccacctcactccgccctctccccccaagctgacccccacctcccagagtcctcacccccaacattgtgcagacagatgactgtggccaccactaccttccccgcaggcccgaatgccctctgtcccagctgctcataggctcggatgcctagcggggggagtcaggaacagggttgaaggtccaggaggccaggccagaggtgcaggccagagggcccaggagctggggagttggggcttgggggaaccggctttgactgatggaggatgaaggtgggggttaagcagttgggcttgagtttgggggcagagtctgggaggtgggatctgaggccagggaaaaggatgagggctggaggtaagagtaggggtcttggagccagactatgaactgagaccatggtaggagctggggaaccggggactgaggggtgggggttagaggtagagtgtagtggtctgggggtgggttctggggtgctgggtccgggatctggggtctgcattcagggagctgggtctggggtctggggtccaaggtctgtgttgagctctggatgtggctccagagtctggggtccaaaggggtggagtggggactgggatccaggctctgggtctcacctgcaataccagcacaggtcagcaggaggtggatggagtaggacgacagaagcgcaatgcacagcagcagggccctgcggcaggtggcacagctcagacctggccccaggcctcccacctgccccacaacacccctggccccgcaggccacctatggactcacaggaagaagatgacccccgtgtgggccatggcataggccagccccaggatgccgctgcccatgatggcgttgctgaggttgaacactgacattccaaacgatgtcttcccctcgaactgcacgcaaggagcaaagcccgggcacacattgggacagggcacagggtaaggagactaatgccagggccagggaaagactagagaagaagcaagcggggtggagagaagccaaggagagaccatcggaggagggaagaggctagcagggaagaagagttgaagatggaagaggctgcgaatggggagagctgggaagggggaaactaggacaaactttggagggagcagctggaagtggagaggaccgggggagggtgaagcagccaccagaggtaaaacagctggggaggggagacgctgcgggtggggataggctgaggatggggagtgctggaggaggaagaacagctggaggagaaaggcaggccgggaggggagcagccagggagggcagtcactgggccgaagagcgggtggggagaaacaaggccagggagagagctggaaagggcatatctggggaagaggagtatctggagaggggagcgaccaagtagtgtgtagctgtgctggggagatagctgggcaggggaacagcagggaggaggaggagtggggaagagggagcagtgcgggaggagattagctggggaaggtgccaccaggacagatcctgtggggccactcacatccatgaactggaccggcttgctcccaggagcaggaccacgactgggcaggaagccctcacgttcttgcctgtagctggatagggcagggaaataggggccgataagagggaaatcctaacccctgatccctgagcccacctccttggacccctgactcaccccacagcatccgaagggagggctccattcatctttggatcctgcagttccatcctgtgggcaaagaaatggggtggggggatcagagatggaacgagcatgcttcaaagtgaggggagctgaagaaggggggaggggagtcccatagagaccgatggaaagacggagaaagagacaaggcaggggagcaggaacagacagggatagaaatggaggcagactgacagagaaagagatgagagagagagaagaacaaaaatcagagaaggagagaagccaacagttagttactcagagagacacagagagagccagtgagagagaaatagtggggaagagagagacagaaagctacagagagagccggaccccagcgcagatgagccgaccacgtggagaagggatagcctctcctcccagaccccagactcacgctgtctctcttgccatctgtgtctttcattccccggtcccccgcgccaccccctctccttccctccaccctcaccgcgtggccaggcggctcactccttgcagggacacgtgtcggcctggctgccccacccctcctaatgccctcacccccctccttcccgcctgggcccccaagcccgagaccagagctaatgcaacctgttgagtgagctgagggttggggacagactcggagacccctgccccagacgctgcaaactgctctctgccacgactctgaatatcctcactagaagccaaagacaagtgcccgaaccgagccccttcccagggacagaaatgacccagggactcccatttgaccccaattctagggcctagaggtcttttccagggcccctagcaagtcttaaacactcatcttctggcagaagtcaatttggagacactgccagacttgagaaacttcctaggtgtggggtgtggggtgtctcaggaacctggcccgagccctcatttcccctccggaggaagagctatttctgagaccttcatcaaagaccccctcccgtggcctaccgagtttcctggggtgggggtgtctctgcaatccccacccgagcctggagcccctgtcttgtaggtacagcgtctctgaagaaaccccagctccctcccgcgcttactccttgggaaggaggtatctcagaaacccccattcaaggtccccattagagctcaaactggctcaggaaatccttttcccaagtcctgaatcccgttcctgggacagggagggtctcaaggagtcccatcccccaccaccagcaccctccggagcctcccacccacacctgaattcacttcctgggatcagggtacaaaaaggacctccccatacacgccattccattccccactagtgctaaaatgtctccaaggaaccccgagccccctcccaggacccctactcatatctcaggcccccaggaacaccatccccgcagcccacgctccctcctcacctacctgctcctctcagctcctgaagtggccgcaactcagactcaggttcgggcaccctctcggctgcctaggctcctgctctggagcggtacttttttttttttcctgagaagaaatgttaattttaatttcgtttccctccttctggccctgggcgggggaagaggtggagaaggggcgccccctatctggacccacttggagggagacagcggtttgtttgtgtgttgatggtgggggaaatggcctgaaagattgagggtgtagacccacagctagagagagtgacaggcagacagaggggatggactcacagagcagacggacagcaggatgggatggatggcagaaaaaggtgcagagaggagacagagagagagtaggagaactgaagttacaaagaaagcaggcatgagaaacagcacaggaacagacagaccacagaagggacagaaagacagatgggcgggaggaggggatgctaggggagcttggaagacaggcagagacagggagaaagggacacacaggcagactcagaaacaaacaggtgggtagggataggctcgtggaaacacctgcagaaaggcaacaggcaattgggctcagtcatagacaggagacacaggctggccaagaggtgggggacagagccagacagctccccaaacagagggtaggaccagacacaccagctcagagagatgaaggggcagagagagtggttgaggcagagagactcctggagggacaggagaaaagaggcagagagaggcagattcaggcagagaggcctggggacagcaggggaacaggtgcaggggtagtagccaggctattccaggcagacctcaggcagacagcctaggcacgagaggaccctagatcttgggggcccccagagggaggcagggagggcatttgtggctgggtggggaatgtggactgtgaactcacactgtccgcaaactgggcgggcactgtagtcctggaccccaccccaagcgtggggtggggcttgtccaagccctgagaagtcccactatctgtctgtccgtctgtcttctatgggagtccgtctgttcactcccctccaggcatatgacaggcatgcctgtcccaggcaagccacgtgtccgctacaggatgtcaggcagggtggacttggggtctgggaccacctcgactgggctgcttgaagcccaggtggacaagaggcctctgtctgggcccctcgcccgcctgcccacccccgacagggaacacagaattcccggaaaggccaggagctggctggggcttcaaagctggcctagatgccctcaccccacccacagttggaggaggacaagggatggggcgtttacttccccacagcgggagagagactcctgcacactcaggaatcgcagctacacaacaggacccatcacagccccatcaaggggctcagatacgggggccaactcgccatcactcacagaggtgcacaaagactcacagccacacaagagaataaagactgacagacatgaacacacacagactcaccactgcacgttaagagcaatggctcatgggacagtcacacacgtggccacacagagtgacgatagtcttacagctatcaataccgacaggctcagagccgctcacagagagcacagactaacacagggataggcttgtgccgatttccagacactcgagactcctgaacctcaccgcccgtggacccacagccatgccaaagacaatcaacaggcaaatcacacacacagattcacagccacacacagagcacacaattacacacagctgatgacattgtgtgtgggtcctgggtctttcccacacacacgatccaggttcagatggccctggatctgaacctgaatccaggttcagatgaccctggaggcaaacttccaggttcaagccctaaaatgatatctctgtgtatgtgaacttgaatgtgcacttgtgaccacatgtaaccacatacagctccagtcacagagagaggcactcataggctgacatgatttttgtacaaacagaaaagccatagtctccttctctctctctctcctctctctctctctctcacacacacacacacacacaactgcatttcagcaaatggctgcacacagccgtgtacacacacagctagtcacaaatcaagtcagaaaagaaacatatagggaaagcatatacctgcacacaaacacaaagcacaggaatgcagagtacgcttactatcgttgcaaagaaaaaatccagaaaccacactgaaagctacacaaggaaaaaacaagagaaccagatagtactcataccatggcaccagaagaaacaccccgagggcacacatacctgcagccactcgctaagaagagacacaaatacagcagcagacacacaaagaaagatacgtgcgcatagatacacatataggagggacaagtactctgacacacttgtcacccacgaccattacaaaggagacaaacacccaagcaacacacacacacaacaacatatagatgaactgcaccgacagacagtaccaatgcacacggttgccaaaaaaaaaaaaaaaaaaaaggtatgagttgggccgggtgcagtggttcatgcctgtaatcccagcactttgggaggccaaggtgagtgaatcatgaggtcagtagttcgagaccagcctggccaacgtggcgaaaccccgtctctactaaaaatacaaaaaaaattagctgggcgtggtggcgggttcctgtaatcccagctactcgggaggctgaggcaagagaattgcttgaacctggaaggcggaggttgcagtgagccaagatcgcgccactgcactccggcccaagcgacagagtgagactccatctcaaaaaaaaaaaaaaaaaaaagcacaagtttggcaggcggccatagacagaacgcagcaccaggcaagttacataggaagacgcaggcacagctcacatacgtgtggctgtggctgagaacgggcaggtgagatacactcagcatattcacacacacgtgcgcacacactcctgcccaacctcctccagcctctgtctcctttcctatctactctgatttctctctcccctcatacccctcccccacccagagccattacacatctgtgctaccagctggccagggaaagagacacctgtcactagaggctttgacccagatggctaaaggtcggggggtgggggggatgcaggtatccatatttcaagtctgaagtgtcccgtccaaataactagcatactttatttggatttaaaaaaaaaaaaaaaagacaacccccctcccctctgcatccattcgccgcctccctgccacagcctcctgctctgattgctccccttccctcccagggcctgcctctactggccttccaacatggaccaacacagggctaccaggcacacagcaggcgctcaacaaaggccacttatctaatgtcgtattattatcattacttttatttctgccaaaggaactcttctacgggagagatgaacctccatccagctctgagaacccgacagctctgctaagtttcagggcactgcagatagcaggtgctcaacataagccggtatggcagcgggaaaacaaagggaatgtgtgatctggctgcttagaggaatttgctttagaaggaacagatgtctttaagcaggaccgaggccttgaggctgtgccagggataagaacactttgttagttcatcaaagtagggctccttctcagggtcatttaaggtttctgttggttcagtaaaccagacccttgtgtgacacatgggagtcccgtgaaatctgttaaaagtcactttgggttatcatcagttctaaggagacatttgatgaaaacagctcacttcccggtagcatccaggggagggagggacacagtgaagcagttaacagcaaaagctttctcagctctgccacttattagctgtgtggctaaacaagcaaattcctaaacctcactgagtctcagcttcctcaagggcctaataacgcctaactcattgggctatcgagacaattgaattaattaacacaggcagagcacttaagacaatgctttacacatagttattgctcaatacatatttgtgggaggaattaatgatttcttctctgcgaaagcaaagtcccacttgctgggctgcatatgggattccaatctgtcctttcatgcaggctccccacggagtaactctttccagtcacttcctttcctcaaagcagcccctgggcagcaaagtcctagtcccctgcccctgggccacccccctcgttccctcacactgctaagatgcccccaccgggaaagagctggcctggcagctcccccttccttgacccctccaggaggccaagggaaggacacctttacactcagtggggtgccgggtgggagctgcaggccgacaccctacttcgggaagagcctggagagttcagagcctggctcctgtcccccaaacccccggtcctgctggaggaagcaagtttctttgctaaaagttaaacatcctcttcgtgagcgacaagaaaacaggacgtgggaagcgtcccacagggtgaacatgggcccccaatgcctggcaccccctcctctcttgtggagcggaggcctggtggctcgaacccttcctttctcacactcgctcgcctctgcaggggagtcatgttcccacagtcccacaatgcccttgagttctgctgacaaagctctggcttcttccctggttctcagagtctctacgcctccacccagggctccatagaaatgcaggacgcaccactggggaaaaaattaaggaacgaagcaacaaaaggatgaattcaaccaacatttattgaacaccaactgtgcgccacccctgttccaggcactgggaggcagcagtgaacatgacagaacaggaatccctgcctggtgaagctcgtgtgctaaggaatcaatcattctgttttttttttttttcttgagacagggtctcactctgtcgcccaagctggagtgcagtagcacgatgtcggctcactgcaacctccacctcccaggttcaagtgatcctcccaccttggcctcctgagtagctgggactagaggtgcgcatcaccacgcccagctaatttttgtatttttagtagagacggggttgcactatgttggccaggctggtctccaactcctgacctcaagtgatccccccgcctcgccctcccaaagttctgggattataggcgtgagccactgcatccagcccttttattttttaaagagacatgggttctcgctatgttgcccagactagattcaaacccctgggctccagggatcctcccacctcagcctctggagtagctgggactaaaggcacatgccgccgcccctggctaatactcatatgcatgttgccaggattaaaatgaatgaacaaagggaaggacatgctggagccaacttatacaggttgggaggagctgttcaattttcagaaattttgcaaactggttgttaaacagctggtttaacaactggttttgtttgtttgttgagacagggtctcactctgtcacccacagtggagtgcagtggcaagatcaaggctcactgcagccttgacctcccaggctcatgcaatcctcccacctcagcctcccaagtagctggaactactcgcacacaccaccacgcccggctatttttattatttgtagagacggggatctcaccatattgcccaggctggtcttgaagtcctggactcaagcgatccttccacctcagccccctaaagttaaacagctatggttaaaaatgaaatgatataaacttactcaaaactggtaacttcctaattttaccacattccactattctctatgctcttgaggtcatttacccccattttatctgtatggtaaaaataatacatgatagtgcactactgcatctcttttaaactccctgttcagtgaccacaggtcggtaccttgaaatctaacaagaagattgtacctaagccatggaaattggtaaatgctagaaaccagcctcccttccccccacccctccccgccaccacccccgccccagccagtggttaaccatttaccagcacaccactgagggcatttagagcctagcacatggtaaacactatgataaacgttttcattatttttccgtttgtccactgggtcaggatgtatagtctttttttgtgtctgggatggaatttaaaatatttgaagatcacagaattacaaaagcccagagagtggctaagctacacctatttaaccctcccaataatgctgttaagtctatactattgattatccccactttccagacagggaaactgaagttctgaggcagtaaaactcaggcagcgccatgcattagctgtagtgcgatctgaaattgcagccgagcagcctccgcgcgctcgcgcacttcaagaacgcattttccttactgtcacgtttatgccccgagtggtaatttcgcttcccggcacgcgaaaaatgaatgggcgccatcttgcgcgtggcatcttgggaaatgtagtttacaggctcaataacaagcacggtccaagaagggaggggcgggggagcaaatcgatcttggcctcggaagaaaaagaacaaagaatcgctggcaacttgcgcgtcgcgtcgctgcagccacgcagtgcgtggattcagccgctttggccgtgcccgttgcatgccgggaaacgcagttcgcgagccccggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaaggtgggccctggggcgcggaggacaggaatgcgggcggaggctattgaggcacgcctgcactgtcccgcctgcggggaaaggagggaggtccgccctgggcgccgtagctgtgtatggttcgggcggctggcaccgggtgggttctagacccaaggtttgtctgcagaaggggaccagtagacggggtggattcgaggtggggacatgggacgcagcggtcggagccgcctggaggggtacccggtggtcccgatggagctatcatctttgaggtattgatgaggagggacggggagtgtggtcagaaggctgttttgggaggttgggtggagcgtgagggtggggtgttactggggaatcaatgggggctaataagaatattttagtcgaactgttgttcattgattgattaatgaggggatggcagagtaagcaactagaatataacgagtgatggatgggaaaatgatcccccaggtattgatggaggtatgatattcaacgggttaatggaaagtgatggggcatcgtaatggcaaggatgatggtgaggttgtggggggaataatagatggatggaggtcatgatcaaggggccttggtgaaagaaaagataatgagaggctgatggtgttgtagtcagagtcagtagttgggctatggtggcatgaccgtcgaggaattaggggacagagtgagtaaagagagggcaatagtaaactagggttgggggggttaacttctgttgatacatagtaggtgaatagtaaactgttggagtgtgatcatccagtgatggatccatggagagcagggtggacagtgaggggagaatggggaactgatgtgtgatcagttaacgtgtttgttaatgaaagagttacagggcaggaggctagtgctgtgatctatgaagggtctattggagaaaactgagttaatgggggctgataaatcagtaattgaatgcttaatggggagctaatagaccatgattctccaggcattgttagaggttcataaggatgtagtaataaaggggcctaatcatctaagggattaatggcgaatggggtgaaacgagagagatatagggagtgggaggtacaatgaagtagtattaggataaaggtggaaaacaagggattaatgggggctaataggactatatgaatctaggggcaatggggacaactggggatacagtcagtgagattttaatgggcatgacatgagcagagaagggttgatagtggcagttgcagggtttaatgtgtggagtgtgggtgacagtgatgggaggtggacaggttcacaagtgggccatctatgggatgaatgttgggtttatggggtcttttgtgggaactgtggggtaagtgatgggggcgaggagggtctgtgtgataagcagtggagcctgagagttcagtgattgggtccttcaggccctataaggtcagtggggtcagtgccagggcttcagtcagcccatcttctgtgtgagctgtcatgtgggtcagatgagcccagtttagtttgtgtggttctctccgccctacagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggtccctgactggtgggcaggtcactgggcggtgaggtgggcacaggaggtaaacaagtaggctgggtctgcagagctccctgtggtaggtgggctgactcagagggtctctggggcagggagacaggcaggaagataggcagaataccggagaggagttgggcacctgggcaatggagatatgtgggtgctccccaggggagaggggtgaattttgcaagggtctccaggttggagaagtgggtgcagctgatcaggatgctttcactatgtatgcccaggcgtgacacgggcagttgacctgtgtgcagccccaggcagctggagccaggtgctgagccagaagatcgggtaagtgtgggggtcccagatgggagacccaggagggccggctgggtgggaggggcccgggagcgaaactaggctgatgtgggccatgttgtccacaggggccaagggtccggccacgtggtggctgtggacctgcaggctatggctccactaccaggtgtggtacagatccagggggacatcacccaggtaagagcatggctgagggtgttggggtatatcctgggtgaaggcccttacctggggtctatgcagagtggaagagaaacagagaggtgatagaaacagagagagaaagagagtgagagagtaaccatggagaaacagtcagcaggtcatcattgcacagacacagcagaaaatgatgatgctgggtccccagaggtggagcccagtcttagagaggcaaagcctgggaatttggctgacccaggggctgtgggccaggaccatgggcaggcgggatctgagggcagcagtggagggccgtggggccactcatcctccctctctccatagctgtccactgccaaggagatcatccagcactttaagggctgccctgcggacctagtggtgtgtgacggggctcctgatggtaaatagcaacagaaagtgggaggccaggcggggccccctgtgtgtgtccttctctgtatctcccaccttggttgacttattcacctcttcagttactccctgcctctcccttccgcactcagctttctcccacatctggcaacttctccctacctctgctgcctgttctctctctgcctctctcttcctcccacttgcaccccaccctttgagtttcatgtctgttgtctacctttccctgctctcatctctctgcaactgtccaattccgttgcactgttcattcattttcagccagccagccattcaacacacatttactgagcacctattgtgttgggaaaacattcatgaataaaattccattaatctttaacctcatggagctgatgttctagtgggagcaaatgggaaagaaaataaatgattcagctctgtaccattaaaaggggatggggccaggcatggtggcttccacctgtaatcccagtgctttgggaggatgaggtgagaggaacacttgaggcaggagtttgagaccagccttgcaacatagcaagaccctgtcttaaaatattagctggcatggtgatgcatgcccatagtcccagttactcaggaggctgaggtgggaggatcacttgagcccaagaggtcgaggttacagtacactttgatcgcaccactgcactccagcctgggcaacagagtgagaccctctctctaaaaaaacggggtgaggaggccgggcacagtggctcacgcctgtaatcccagcactttgggaggctgaggtggtcagatcacctgaggtcaggagttcgagaccagcctgaccaatatgatgaaaccccatctctactaaaaatacaaaaattagccaggtgtggtggcatgtgcctgtaatcccagctacttgggaggctaagacagaagaatcgcttgaacccgggaggcggaggttgcagtgagctgagatcgcaccattgcactccagcctgagcaacaagagcgaaactccgtctcaaaaaaaaaaggtggggtgggggatgggtaccatagggaaatcattgagcaggaggaaagcaggagtacctgttggaattttaaatcaagtggatggggaaggcctcactgacttaacagcagagactaaaggaggtgggggagtaagctatggatatgtctggaggaagagcaatccaggaaaaattgcagcccgtgcaaaggtcctgaggcaggagggtgcttgctatgtatgagtaatgacaagcagatcactgtggttggaacagagtgagggggggagagtggtaaaaggtaacatcagagaggtaacaggggacagatcctatagggcctcgtgggccatggtgaggctgttggcattttcaccgagatgagagcttggagaaaaccatgagagggttgtgaggagaagaggactgtgctgggcttgggctactatgagctgtgtgagggccaagggcagaagcaggggctccggggtggagtagtccaggcaagtgataatgggtgagggcagtggtggagaggagaagatcaagtcagatcttttgaaagtagatgtgttaatggcttcgatgtgggtgtgaggagaggatgcggggggagcatcagaggtgactaaggttttggatttgaacaattagaaagctcagatgagatggggaggatggtgggaggagcaggtttggggaggtaggtcaggagtttggttgtggatgtattggagatgtagaatctgatttgtgaatctggagttcagaggaacagtctgggctggaggtggaaatgataatgatgcttgtgtgtgaggttgttttagaattgaaatgagttcctaagggttaggagctcagaatatgcatccagttggcagacagtaatttgcatctggaaccttagcagtaagacagcctggaaaatgtatttagtgtctgatctgtgtggtacaagaagatgcacagagccagatgggacccccctaacgctgttcctcttgccacagtaaccggtctccatgatgttgatgagtatatgcaggcccagctcctcctagctgtgagtaaccctggccacccctgacccactttggccccctcctggctgtctccacctcagcctcagccgtctgtcctgcccacaggctctgaacattgctacacatgtcctgaagccagggggctgctttgtggccaaggtaagtctcaaggaacttggtggagtagagggaggtcgctgagggccaccctcacccgctgtctttgccttctcaccctgcagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacggtgagagctggagcatgggccaccctgggggactctgccacaccttatgcaatctaggtcccatgagggcccacagtctcaccccctgggggaggctctgtcccctcatgggaatttttttcccaaggggatccttagccccattctctgatggaaatcccacccctttatgggtattttgtcccgggaggagcttcagcccaggcagtcctctagtggtaactcttgggcctggtgaaaattccatcccaggaggatcctgagccctgccccagtggagactccacctgcctaaggacattctctcctaggaagatctcagtcatgtcccaggtggaaacctcctcggtgtgaaacttttgccccttaagcctctagcaggaagagacagagcctgcccctgggatgacatttgagtgagggagacgtcatccaggcagcatataatccaatatcaggtggacataaatgcagtgaaaaatagcagggcaccgatgttttagaaggggtgattatggagggcctccccgaggaggtgatctgaaccaaatgaaggatttctggtggggtgggaagagagtagctggtggatatgtggggagggtttggcagccataccgccgcctgtgtcatgactggccccaggcatcctgaccttgtcctcagttgtctccccctgttcctaagacccagatttcaaccagctggatggtcccacccgcatcattgtgccttttgtgacctgtggggacctgagctcctatgattcggaccgcagttacccactggacgtgagtgcccaaccaacagtaggtgggtgggagggaggctgtcctaggttaccaggtcctcaccatctccctacccctctgtccctgcagctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaatatgtgagtcacttttctttttcttgggtagatggaagacaatgaaatgagttgttcaccttaacccattacggtaagtttgccttgttatctaagagtttgagtaagggcaacctttatgaaaaacctcagtaaaatttcacctttgaaatttttatgtcaactgataagattttaatcaacaaacccttttctaaacatctgttgttgtatgccaggaactgctttaagcattttacatttgaggcattcagtaaacatttattgagcacatactgtatgtcaggtgttgttctaggtttggagatagagcagggagcaaaacagaaatatcttggctctcacagtacttccagtttggaaaagaggcaacaatcaaaacagtctgtaagtgcaagagtttacatacacatatatactatatagcttgcatttctcaatttacatatcttgcaatatatataatatataagagtaatatgggatataaaaaatagaaaaaagtaaagcagggtgaagagaatcaggaattctaggcatggcagttttcatcttttggtgtttttgttttgagacaaggtctcactctgtcgcccaggctggagttcagtggtgtgatttcccgggctcaaaaaatcctcccacctcagcctctcaagtagctgggactacaggcatgtaccaccatgcctagcaaatttttgtatttttaggggagatggagttttgccatgttgcccaggctggtctcgatctactgggctcgagcgatctgccatcctcggcctcccaaagtaccaggattacaggcatgagccactgcgcccagccagtttgcactttttaaaagggttgtcatagaaggcctcagacattcctcagaggtaatgtttgagcaaagacctgaaggcactgccggagggaagccatgtgtttatctgagggaagagcattctgggtaaaggaaataggcatgtcccaaaggtggaactgcacgtggtatgggaggaaagtttatccatagccaaatgttctaaaaccacgatgttagaggatggccctttctgacaatggcatagcaggttattcagactaagtcagccatcacaaaaagccacctttttttttttcttgagacagagtcttactctgttacccaggctggagtgcagtggcatgatctcagctcacggcaacctccatctaccaagttcaagcgattctcctgcctcagcctcccaaatagctgggattacagtgcccgccactatgcatggctaatttttgtatttttagtagagatggggttttgccatgttgaccagactggtctcaaactcgtgacctcaggtgatccacctgcctcggcctcccaaagtgttgggattacaggtgtgagccaccacacctggccttttttgttttgttttttgttttgttttgagaacagagtctcgctctgtcgcccaggctgggtggagtgcagtggcactatctcagctcactccaacctccgcctcccgggttcaagagattctcctgcctcagcctcctgagtagctgggattacagacgtgtgctcccacctcacccggctaatttttgtatttttagtagagacggggtttcaccatgttggccaggctggtctcaaactcctgacctcacaaaatctgcctgcctcaggcctcccaaagtgctgggattacaggcctgagccaccacacctggccacaagaagccaccttaagaaaaaattgaaacagcaaatcattgtgtgaaagagatttacagtttttaatatttaaagggtcctgtaaatcaataaggaaaaacatgagagtggccagtaagcacatgaaaagctgctcatcaggaaaatacaagtgaaaactcaaaatatcaacaacactaagtatttgaaaggatatgcagcaattgaaagcctcgtacatgctactgggaaggtaaaatggtgcagccactgtggaaacttaggcattacctactaaagctgcatgtgtgccagttccactcctaagaaatgagtcctagaggccgggtgccgtggctcaacgcctgtaatcccagcactttgggaggccgaggtgggtggatcacctgaggtcaggagttcaagaccagcctgaccaacatggcaaaaccccatctctactaaaaatacaaaaattaaccgggcatggtggcgggcacctgtaatcccagctactcaggaggctgaggcaggagaatcacttgaacctgggaggtggaggttgcagtgagctgagatcgtgccactgcactccagcctgggtgacagagtcagactccatctcaaaaaaaaggaaatgagtcctagagtgttgctagcagcactatctatagtatatgcccattaaatcgtggtacattcaccgtggagaactgtacaacaatgacagtgaacatcctgcaattacaccaaataacaccttgtagttattcattaaactgaacatatataggttttatgcattttctatatgtcatggttcaccataaaaggaggaaatgtcacaaaaatgttagcagcagagttagctaggtgtggtggcacattcctgcctgtaatcccagctacttgggaggctgaggtgggaggatcacttgagcttgggaggttaaggttgtcgtgagctatgatggagctccactgcactccagcctgggtgacagagcaagaccctgtctctaaaaaaacaaaacaaaacaaaaaaactttctttgacttttggttagctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgtaattgtgtgtgtgtgtatgtgtatgtatatacttttaaaaatattctgtgaaggggttcacagatttaaccagatgccaaagggttctgcagaacaaatttatttatttattttgagacagaatttcgctctgtcacccaggctggagtgcagtggtgtgatcttggctcactgcaacctctgcctcctgggttcaagcgattctcctgcctcagcctcccgagtaactgggattacaggcacccgccaccacacccggctaattttcgtatttttagtagagacggggtttcaccattttgtccaggctggtctcgaactcctgacctcaggtgatccacccacctcggcctcccaaagtgctgggattacatgcgtgaaccaccgcacccagacttcagaacaaattttttaggttaaaaacctgtcttaaagaaacgtcagggccaggcgtggtggctcacgcctgtaatcccagcactttgggaggctgaggcaagcggatcacttgaggtcaggagtttgagaccagtctggccaacatagtgaaacccgtctctaccaaaaatacaaaaattagctgggtgcggtggcacatgcctgtaatcccagctactcaggagactgaggcaggagaatcacctgaacccgggagatgaaggttacagtgagccgaggtcgcgccactgcactccagcctggacgacagagtgagactctgtctcaaaaaaaaaaagcaatgtcagaaagtctacctggactgcagtcctaaatttctataacttaatgaacaggagctgacagaaactccccagctacacgaacagaactgttttctacagcttaatcctgtgtccttagaaattcacgtactctgtgatccaaggactatccacgccacagtccagtgacctcaggagtatccacataccagtctgcgaccccagctgtttccacacctgactgtgactcaccccagttaccatgtgtgaccccaggagtatgcacactcaagtctgggaaaaccattgtccaatctccagtcagaaatggtgtttaaattctggagcgtgtgttcataggcatgtctacactccggtctctgaccacgaaaataaccacaccccagtctgtgtgactccaggaatgtccagaccccagtttgtgtcagtctaggagtgtccacaccatggtgacttaacccaggagtcttctcaccgaagtcagtgtgaccacaggaatgcccacaccccaatctgtgaatatgcacagcccaagaatgtatggcggaagtgtccacacaaaaggccgtgtgaccacaggcgtagccacacccattacagtgcaaattcagcagcgttcacacgacagcctgtgagacctcaggagtgtcctcacgccaggttctgtgagtccagcagtggcaatggcttggagtttccatagccatcttagtggtgccataaatgtgtagctcaaacggtgaccacagaggagtccacagctcagtctgtggtgtcctgggagtggttttgccccagtccagccacctcaggagtgtccccacccaagtttttatgacacaagtaatgtccagttcccagcatatgtgaccctggtgttgtccaaaccccatagtctctggctattagtgtgtctatacccatcttgacggcctcaggcaggtgcactcccccatctgtacgaccagaagactatcgactcccctgtcattgtgaccacaggagtgtaaaactccagtgccagtgactactggtgggtccacattccagtctgggtgacccaggggagggcacagccctgtctgtgtgaccataggagtcttcacaccccagtgtctgtaaacacacaggagtcaattccccagtcagtgtgaccagaggaatgttcacaccaaattgtgtgaccacaggagtgtccacacctatctgcatgtcctgagaggtgtctatactccagtgggtatgacaccaacagtgtccacaacaaagtctgtgtgactccaggagtgtccctccccccagtcagtgggagtctagaaggatctacaccaagtcttgggagcccaagggtgtcccttcgccaatctttgtcactcaggggacattcaccccccagtcacacagacgaagcatatccacagctgggtctgtgtgaccccagcagagtctacttcacaagtcgtgtaaccacaggagtgtccccagacgaacctatgggaatccaggagtgtccacatcacagtcacttgaccacagtggtgctgacttcccagtttatgtatccttagccatgtcctttttccagactgtgtgaccctaagtgtccacaccccaaactcggtgatccaagtcactccagtctgcgtgactccagtgttgcccacacaccaatctgtatgaccctaagagaacacatcccggtctgtgatgcttcagcagtggccacaccctactctgtgtgaccccagaagtggctacaccacaatcagcatgacctcaggatttcttactccaaaatctagtaacatcatgagtgtctacaccctcacctgtgtgattccaagaggatccacaccccaggctgtgtgaccctgggaaggtccctatagcagtcagtgtaaacctgggagtgcactcttccctgtcagtgtgagctgggagggtgtatctagaggaagagtgatccagggaaaggcgaagggccggatgtggtggctcacacctgtaatcccaacactttgggaggccaaggtgggtggatcacctgaggtcaggggtttgagaccagcctgggcaacatggtgaaaccccgtctctactaaaaatacaaaaattagccaggcgtggtggcacatacctgtaatcccagctacttgggaggctgaggcaggagaatcacttgaacctgggaggcggaggttgcagtgagctgaggttgtgccactgcactccagcctgggtgataggccaagactctgtctcaaaaaaaagaaagaaaggcaagggccctgaggcaatggccctgaggtgcctggcacatttgaagaacaggccagtggggcaggagcagagtgaacaaggagccagtggcgggcggtgaggtcaaggagggcccggagggcctcgtgggccacggagaggactttggctttttctctgagagagatgagagccatggcagggctccgagcagaggagggccccgggctgacttgggttgcaacaggatccctctggctgctgtggtggcggctactcaactgttattgtttgtcaaaactcagagaactgtatgccaaaagggtgaactttatcgtatgtaaattataactctttacatttaagttataacttttggaaaatgtgcagtactggccaggcatggtggctcatgcctgtaatcccagcactttgggaggctgaggtgggaggatcgttttagcctgggagattgaggcggcagtgagctgagatcatgctgctgccctccagcctggacaacagagcaagaccctgttttgaagaaaaaacaaaaaacaaaacaaaacaaaaaaagtgcagtactttgcaagcaataaagatttctatttctgcaagagaggctgtgctcatgcctgtccttacccctctccttcctgcacaaacacatctcaggaatgcacctgaggaaaaggagggagccggggcctccctcaactgctcaaggtagtgctccctttgttgtctgctgtgaactgaattgtgaattcagcaaattcctttgttgaagctttaatcctcaatgtgactgtatttggagatgggggtaattaagattaaatgaggccataagggcagggtcctaatctgatagaaccggtgtcctcattagagagggaagagatgcctgagctccctccctctctccctgtgggcgcacaaaggaaaagccacatgaggacagagaaagaaggtggctgtctacgagccagaaagagaagcctcaccagaaaccaaccctaccggcaccttgatcttgaacttccagcctccagaactgtgagaaaataaacgtctgtggtttaagccacccagtctgaggtattttgttaaggcagtctgagcagctaattggctctcagtttcaaggctgatttcaagagactcgtgttggccaggtatgaggggagccagtgctcaagtgaaggaaggaaaattcagcacatcctcctcgtctagctgaagggggctctggagcagcaggaggggcccagggcaagcctggaatgaaatccgtggcactcctgcaggttctgggggcggtgtccatggaatatcctctgccacataacaaaatgactaataattgcttggggagctttcagaactgccccaaggcttcctctaacactccacccacacctggttcatgccaggttgctcgatgccttggttcgggagaataggtgtggtgtcatctcaggcttggtggcagcccaagggaaggggcaagtgttctgagtctctctagatgacacaggagctgaggaaagctggagtgaattatgagtcacagcccgtacctcacaagaaagttctgcccgatgccagagctgggagccatcaccagttatgcagggttggtggagaagagcctcgggataattggtatgcatgcccgcacataggtgtgtgcgtaccagtacgtgtgaagttatgcaggagtgcgtggtgtgcttatgcccatgtgtgtgcacattagtccttttgtgcatgcatgcatacatggcacatgtgtgtgcattcatgctttgctgttttgaatgcaggtatggttataagtgcatatgggcaacagaagttcaagtgtgaattctcatggagatgctagggtgtagcaggcacatggggacctgttccctgacaggggtgtttgtgaaaagcaactgtgcatatgtgtgagggtgtacttatatatgagattctatgtgcaaagccctatgtccgtgggtgctagcctgagtgtttgtgtctgtgtatatacatgtgtatgccagcgtgcacatgcatggctgtgtgtgagtgcgtaagtgaaggggagcacattggcccaagctggtaagtctagtatctatgcatgtatacccctgggcaccgccccccccgccccgtgcaagtgtgagtgaacaggtacacaagggcctgggcgtagatgtctgtgcacatgtacgtgggcatgctgtatgcatggctgcagggatttcccacgtgtgtgtgtgcacagatgcacaagtgcccaggaacctagattgtggtgtctgtacacatgtacctctgggcaccatgcatgtgtgtgtgcaaaagtgcaagtgtgcctatgggctcaggtctggctgtctgtgtacatataccccctggatgcccataaaggtgtgagtgtgtactgcaggtgcatatttgtccgtgggcctcagtctgggtatttgtgaacatataacctgtgtgaacgtgcatgggtgtgtggatgtgatcaggtgtgcccatggacccaggcctcggtgtctgtgtacaggtacctcagggtgcccgtgtgtgtgtgtgtgtgtgtgtgtgtgtgcgcgtgtgtgtgtgcatgtgcatgtgtgtatgtgtgcatgtgtaactctggaggtccatgcatgtgtgtgcgcatggcttcaagtgtgtccaaggacctgggtctgggcatgtgtgtacatgtatccctaggaacccatgcatgagtatgctcacgtgttcagcggtgccaatggccttggatcttggtgtctgtgtatgtgtacccttgggggaccacagatggcattcatgcatgcatatgtagcaccatggagggatctgtgtgcagatttacctctacctacacctggctggggatcataaagaaaatcaagggatgcgctacctccatgaatccaggtttcagcagagctaagggagtgaaatttggggccattttacttgtctcaaaccttgttatctgagagaaagctagagcttccttctttcagcccccagagacaatgtggccaggctccggagggctgggaagatgagcaatgcttgtgagtcaccatgataggaagcagaagggtcaggaagtccctgggagcaaggcttagggttagggttagggagaaaacacttgggcctggaggctcggggcaggcttcctagaggggaggggtaggaagaggcagtgacagggcccacagcaatggagaggagttggactgcagggatggggtagggggacagacgacaagggacactcagaagactaatgtctgggagtgggaaaacagtgtttgctcagccaggaagctgcatccagctcttttatcatttgtagaagaccaagtacccaggcctgggaggagcccagagatgaaccagagtttggagctgggggcgggggtagttctctctgtccctgtaacaggcagtttaggcttaaagagctgtccaggctgggcgcagtggctcacgcctgtaatcccagcactttgggaggccgaggcaggcggatcacctgaggttgggagttcaagaccagcctgaccaacatggagagacccccgtccctactaaaaatacaaaattaggcaggcgcagtggcacatgtctgtaatcccagctacttgggaggctgaggcagaagaattgcttgaacccgggaggaggagactgcattgagccgagatcacgctattacactccagcctgggcaacaagagtgaaactctgtctcaaaaaaaaaaagaaagaactgtccaggattccacgggcccctggggcccagggtaagctgcctcccctttctgggcctcggtcttctccattgtcacatggcctgcctgtctgcagcccaggccccgggaagcatttagcctgagagaggagcccatggacagtgggcaggcagctggctgctccccaagattgggccaccctcctgctcctctgccacttcagagtctttacaccctgccccagaggcaaagcttggaaatgggctgggggagccatggccacaggccagtcagcatgggggaagcctggtggggttgaaaccctgggctaggagggggcacgtccatcacgaaccctggtcccccaccaacccacccgaccatagcaggggaggcacaggaacccacaaccttcctcctgaccccagctggagaaggatgttgctgctcctgaattccaagctggcccagatgtagagtggtcccccaagggtatacttgcacagacaccaagatccaagcccattggcacagctgaaaacatgagcattcccatgcatgggcccctaggggtacatggacacaaatctccccttccagtcatggcaccccagtcctgatcagcttcaccccaaaaagctcccaggtgcggagtcaagaccttcttgtgcccccacttcaaccccaagccaatggcttctttttttttttttttttccagagactggggtggaggggtttcactctgtcacccaggctggaatgcagtggcacaatcatagctcactgcagccttgatctcacaactgatcctccgtcctcagctactggtgcgagctaccacgcctggctctgagccaatggctttcttttagatcctccagaaggtcaacaatactgactgcagaacgccaggcagccacaggccactgggcacagttgtgcaggctgtgctctaacaaaagttgcctggccacagaggacactgggagcaggaatgcaccctgggctcctctagcatcactggggcctggcctggggccgcgtccatcaggaggaaggggcatccttttctaaagttcacgcaggcattatgtgagctagtggcgcccctcagtgtccaggtttttaaaggcaaaggaaatctggacatgcgcagaaagtgaacatggccccagagccaggcataccttcacccgggatgtctctgagctggaaaaaaatactcagccattgtctagcgcagccctatgcttatcaggaaaaattgtaaaaaacttttaaatggacaaaactattccccaggtgtcctttcaatggaacactggatgtggtctacccaagccccttatggcgtatctgattctatagcgggctgcacttttgtctttggctgggccattttgcacctctgtagagagaagttaacctgtgcaggactgataattcccatccataataaatgaattttgtcctgtagagatacagctgatctctatcctgtagaaaaagattattccagatattatattgcatctattggcaaatccattgcagtatctctgggagtttatatatgcttgttcttcagattctcctctgagcctagtgtaacatattaccagttccctcattcataaatgatctgggccaggcatggtggctcatgcttgtaatctcaacactttgggaggccgaggcgggtggatcacttcagcccaggagttcaagagcagcctgggccacaaggcaaaaccctgtctctacaaaaagtacaaaaattagctgggagtggtggtgagcgtgtgtagtcccagctactcaggaggctgaggtgggaggatcatctgatgccagggaggtcaaggtctgcagtaagctgtgattgcaccactgcactccagcctgggcgacagagtgagactctgtctcaaaaataaataaataaatgatctaaaaatccttgacacatgttcactttatatttgtaggagtcgtgatgttaccattttggaaataattttttaattgcatctaccagctcacagtacagatgagatcaccaagctgggggagaagggacttgcttgaagtgaccctcatggactgggactggaaggcagagctgaactcaagctactctgggtgctgccctgctcctggaaggagggggatatgctgtgcccaggtgtggaatggaatggagggctgtgacacacctccaccatggggatatggagtgaccttctgagatgagggggtcatctgtcaggtcccaccctctgtgctgtgccttgattcagacccacgacacaaccagccgtccaccccaccccaggtggtcctggccaggggaagtgctgaaatgcccccattgccatcctgaactgctatgctggtgatgaccataggaaagctttattctaggtatactatttcaactgctgggccccagcttccttatctataaaatgtagttagttccggttcctgccttatatgatgtggagaagattaaatgagattatggacacgaagctcttcaaattgcccggcacagagtaaacgctcaatatttatcagctgttagtcattaggtctgtttgacttgcagaacttccagtggtggacatttttgaagggatgcttggggccccctcgagatgctggcctagcaggacccagctgctccatccttggatgaaacacccaacaagtgttccccgggtgatggatcaggaaactcagactcctggccagggaaaacaggcctgacctgctctctggaacccccatgttgccatccaggagatcctgaagcccaaggcacaaatgaggaggagcacaaggagtggtgagttcttgacaggaaatggtggggtgccctaggagaaatcacctcttagggtctcggtttccccatctgtacaatgggcacttcggagctgtgagttgctgaggacctttgcagccgccttttggggaagaacaaatgttctccaagggtgtaacggctggaggctgaccctttcccagcccaggccctgccattagagacaaagtacaccagacacaaagggaaaacccagtccccgccacacaaaggcaaaacccagtccccgccacagcataggaagctgcccagcaagttgagagtcaagttgcccaagttttgtggccagtgaaggggaggtttgcagccagaccactcctgaggcctacctggggaacttgtgggggttgggttggggggatggactcagtggcctctggggtcccttccagtccagactctcctctgtggctggcatgctctgacctcagaggtccaatctgcaaaatgggacgataaccccatgtgggctgagagggcaggaaggtggatgtattcttcagggttctgtgagttgtaagtggcagacactccagtcaaaccagcttaaggtaaaagggaataattactcaggtaatggaagagacctgggacagagtgagctttggccatgcacagcgtgtctgaggactctctctctctgtccaggaggtctgatttatctttgagagcttggccctcggcaggctctcccaggtggtggctgcctcgcctatccctaaacagcaaggagtcccagaggacagcaaagcctctttcccttcagttccagctttagatcatgtggcctggcttgagtcacacccattcctgaccctgtggtcacaatgacagattgctctgattggctggtctagtcatgagtccactcctgaagatataggtgggagcagggaggtgggggagttagccccacaagaacaacatgcactggagtgaggtgaggaggaagggggttgctaaaagaaaatggaggtccagccgggtgtgttggttcacacctgtaatcccagcactctgggagtctgaggcgggcggatcacaaggtcaggagtttaagaccagcctggccaacatggtgaaaccccatctctactaaaaatacaaaattagccaggcgtggtggcacgcgcctgtaatcccagctacatgggagactgaggcagaagaattgcttgaacccgggaggcagaggttgcggtgagccaagatcatgccactgcactccagcctgggtgacagagcgagactgcatctcaaaaagaaaaaaaaaagaaaaaaaagaaaatggaggtcagacatgatggttcacatgtgtaatccgagaacactgggaggctgacttgaggccaggagttcaaaaccagcctagacaacatagtgaaaccccgtctctacaaaaaatacaaaaattagcttggtgtggtggtgcatgcctgtagtcccagctacttgggaggctgatctcttgagccctggagtgagaggctgcacctctcactccactgcactccagcctgggtgacagaatgagaccctgtctcaaaaaaaaaagaaaagaaaagaaagaaagaaagaaggtggtctttcatagaagaggaaagaggtgctgagttggtaaaaggaatgcctgcccaatacagtaggccaccgctgaatccttaagtaaaaccactggcagccttagtccctctctgcctaccactttcaggtgctcagctttatgctgtaaagttaccccatcactcctaaactcggaaattctgcctcccatgacagattaaaaggcaatttatactaaaatgtcaatgactaccagattctgaagaaggcaaagcctcactggatgtgacttaatcttctagtgagatttagggccgtgtggcaaaaggatggggagatgtcagggagtgtgccaagtactcaatggaccaggcagctcaaaggcagccccgggaggagagagcaacctccttcccatgttctgtctccattcagagcagatggccctcccaggcgcatctgagctcccggctcttctgctcccctcctctgagggacctgtctgtctagctatcagcctgtcagttcagctctgctgcaaagctgttgtgtaggtgtatattcatcgagtgtctgttcctaacactgatttcttggcagagagaagtcagttcatccaaccattaaggatgagttctgtgtgagagggtcagagaagaggattgggaagcagatggagcaggttagaacattagaattgttatcaacccgctctttcttgtagatacccacagttcatctactcaaccactcacttagccttgcgcccattcatccacccatgattcacccacttacccactattcattcatctgtttatctagccacccatccgcacacccacataactggtcactgctgtggctccagctttgtgccatgcattgggagcacagagatgagtcatatcccctcctgctctttcagccctcccagtctaactggagagacatccacaggcaaatctcgctgcatgattctgtgatcaatgctgtggttaccccagggagcatttgattatgaccctgacattttagccgagtgctgacagatctcttggtgttgccaggagagaggaggaggaaggacattcctagaagtgggaacagcgtagataaaccctgggaggtgtaagagagaatgagtgtggttaaagcgcagggtggatgaagggctgaggcagaagttggcacttgggctgggtgcagtggctcatgcctgtaatcccagcactttgggaggctggggcgggcagatcacctgaggccaggagttcgagaccagcctggccaacatggtgcaaccccatctctactaaaaatacaaaaattagccgggtatggtggtgggcacctgtaatcctagctactccaaaggctgaggcaggagaatcgcttgaacccgggaggcggaggttgcagtgagcaccaagatcacgctgctgtactccagcctaggcgacaaagtgagactgtctcaaaaataataataaaataaaagaagttggcatttggaagctgagcaggggctttaattcctagtcctggggtgccagggatggcttttgagcaaaagagccagcacccagagtgtggccagaggcctggggaagctggcctggggtagccagcccgcttttgctccaggccccaaagagacacatgtgccaacccccagcctgcaattcaaagaaagaaaaagacttcaggaagaacgccatttacagaaactgtccctgagatggatggacagatggacagtgggatgctgagatgtctggtgggtgtacagatccaagcataaactctggtccacaccacacgctttggggacacataccagggaaacaatgtggtcaggggaatcaggcatgtgcaccccaatttacctggctctgcagggcttggagggcttgcaggatgcatggccacgttgctgagggaagagggccagaaggtcaaagccacttccagttgggactctaagaatttcctcaagggggccgggtgcggtggctcatacctgtaatcccaacattttgggaggccaaggcaggtggattacttgaggtcaggagttcaagaccagcttggtcaacatggtgaaaccccgtctctacaaaaatacaaaaattcatcttgcgtggtggcgggtgcctttaatcccagctgcttgggaggctgaggcaagagaattgcttgaacctgggaggcaaaggttgcagtcagccaagattgtgtgccactgcactccagcctgggtgacagagcaagactctgtcttcaaaaaaaaaaaaagaatttcctcaagagcagcagcttctgaattttcctgagtgtagctgaatctttatgctaagaaaccatcccaagacctctgccaggagcactgggtgctgttagctctgtcgaatgatgttgtccttcacaaggagtaagagccaggaggacaattgaggatgtgtcctaagaatgacaccccgtgcaggggatggggctcagtagtgaaccaatccctctgcccagggctgccagccttccaggtgtcagacttggtcaggaaaagtcctcagccttgatagcttggtgtgagagtagtgcagtcagatctcagggtgccagaggaaactgggtcagcagatgatatgccaggaggccctagggtgccaggagctgtggagagacctcagctggctctagaaggaagaagggcagcagtttgcaggtagggtggggtagaaaaccaagggcggccgggtgcggtggctcatgcctgtaatcccagcactttgggaggctgaggcaggtgaatcacctgaggtcaggagttcgaaaccagcctgaccaacatggagaaaccccatctctactaaaaatacaaaattagctgggcgtggtggcacatgcctgtaatcccagctacttgggaggctgaggcaggagaatcgcttgaacctggaaggcagaggttgcagtaagccgagatcgtgccattacactccatcctgggcaacaagagtgaaactccgtctcaaaaaaagaaagagagagagagagagagaaccaaggacaacagggctgcagggtgaggaggacctccccaaaacccaaaagtcctatggcggccccatttcaagcactctccaggcagggagaggccagcacccagcccttcgtcacccctgctattcattggttgatggagtcctgtagtcaacgcttgccagacatcgtctagatgctgagcctagtgcaggcactggaggccacagacagcagagatgcagcactgcctagtggggagacagacacttttgtgtgataaggtttatgaagatagggtctgcccagggtgtgggaatcccagaagcaagaggtaggaagggtctccccgacctgggaagtgatatcaaactggatctttttttgctttattttagagacagggtctttctctgtcactcatgttggagtgcagtggcacaatcacagctcactgcagcttggaactcctaggctcaaggaatcctcccgctagagcctcctgagtagctgggactacaggtgcatgccaccatgcctggttaattttttctttttttctgagatagtctcactctgttgtccaggctggagtgcagtggtgcaatctcagctcactgcaacttccgcctcccaggtgcaagtgattctcatgcctcagcctcccgagtagctgggattacaggcacgtgccaccacacctggctaattttttttaatttttggtagagatggggtttcaccatcttggccatcttgaattcctgatctcaagtgatctgcccgccttggcctcccaaagtgctgggattacaggcatgagccactgtgcccagccaatttttaaaaaaattttttgtagaaatgtcgtctcactgtgtggcccaagctggtctcaaactgctggcctcaagcaatccccccaccttggcctcccaaagcgctgggattacaggcatgagccacctggcctggccggaactccatactgttttccacagctgttgcaccattttacatccccactgacagtaatttcccctatccttgttgattttatttatttttgaggtatttgaaacaagatggtttcaaaagtcagaactaggccaaaaagtctactcagagaggtgtcactgtcacttctccgttctatccctctcacccattccctctaggaaaccaatctcaatagtttctgctttatccttccaatgtttctttttgtaaagataaacaaatacatgtatgttttcttatatcatcttgtttcttacatgaatgcttgcatcctatatttacttttttgcactttgctttttccacttaacagcatgtcctggccgggtgcagtggctcatgcctgtaatcccagcactttgggaggccgagctgggtggatcacctgaagtcaggagttcaagaccagcctggccaacatggtgaaaccccgtctctactaaaaacacaaaaattagctggacgtggtggcaggcgcctgtaatcccagctactcaggaggccgaggcaggaggatcacctgaggtcaggagttcaagaagagcctggccaacatggagaaaccccatctctaccaaaaatacaaaaattagcccggtgtggaggtgtgcacctatagccccagctatttgggaggctgagccaggagaatcacttgaacccgggcagccgaggttgcagtgagctgagatcatgccagtgcacccagcctgggcaacagagcaagactctgtttcaaaaaacaaacaaacaaaaaacagtatgtcctggaaatcgttcctcatcagttcatagatgtcttcctcaatcattttacagttgcacagaactccattgtgtgactgcaccacagtttattcaatcactgcctatgtataggaagtgatattgttttcaatattttgcaattataaaccgtgccacaatgaataaccttgtgcatttgtattttcacagtgtctgggggagtatcttcagggtaaattgctggaagtgggagcgctggtgcaaaagaaaaatatgcatttttgttagatgtcaaattccccttcatcggggttataaaaacgactttttaaaaagcacaaataagaaaagctgatctttgcaaaagaaaccaaacagtctttcttactgacatctaatagtctgcgttggttttaagactgaggcatttaatttcacaaagactgttttttacagagtgatttaatttcaccattgtcacaggctctgctggtgcctacgccacacacacacacacacacacacacacacacacacacacacacacgacctcacatcgccataggagctgcttatcccatctgagcctcagttgtagcctctgtaaaatgggcggcacctgtctggctacaagtggttttagagactaagcatttggttctctgtgagattccagatttcccagaaaatctgatgaaagctgagagctcgctccctaggaacatgctgagaaagagacaagcagcccctgacatcccagagctggcttgatacccacggctagaccttagtgccctcctgttgaacacggacaatttcacaaaacatcagtatcagacaaggccactctgactgtgatggatcgagacaaaaacaagatcagtatgtcatcttgtcttagcacagacacatgaatacattgtccaaaccacaaaaatgaccaagtattccccgacttggctatacaatgcacttttttttttttttttggccaatgacaactttagcctccactctagttagtctgccctccttctagataaaatttattgtgatatccaatcatagaattagccccactccctatccagagcaaagccctgcttccttaaaccatcccccaaatcactgaacacaagccccaatcctattataagttctaactcccttttactgagacaccccacggttccccacagtgtacaccctcccttgttgcaatgagcaataaacccaacttgttcaaccacacatgtgttcctggggggttttggctagaggactttgacagcacttacagagttggctgtaagctcaaggactctttggaaccccatctctgcatgcccctagtccacagactcctaattaagtggccttgagtctagagcatcagtaataccattaaacagatggagaaaccgaggtctagagagattgacttcttcaaagtcccattgtgagccaacagctgggtaggaactggaaactgtggctgctggtcccaaggtgaggtatgtccagcagacatagaacccgtccccaagctccccttggccacaacagtgttctccctgcacaggccacagaactaaccggcaagatacgcacatgcgcatttctgaaggatggcttcattctctccctgtcctgcctttctctctgtagaatggggcagtgagatcccaggttgagggataaaggaacccccacaccggggctaccctcaaggacgctcacacactgtggtctcagcttaaaggagcctcatcttccctgtccagctgctgcgtcccagagtgtgcaccctcacagaccctgtcaccagtagcacctcattcccatctctcaatttccctctgcatttgcccaggtcaggcgagctacctagaacccccctcccttcctttcttgaccttgagttctcataatttttcttcgagatctagcgtggggccaggcatggtggctcacacttgtaatcccagcactttgtgatgtggcaggatggcttgaggccaggagttcaggaacaggctgggcaacatggcaagactccatctctagaaaagaatttttttttttttttgagacggagtattgcagtctagctctgtcacccaggctggagtgcagtggtgatctcagctcactgcaacctttgcttcccagattcatgcgattctcctgcctccgcctcctgagtagctgggattacaaggcgcccaccaccacacctggctaatttttttgtatttttagtagagatggggtttcaccatgttggccaggctggtctcaaactcctgacctcaggtgatccacccatctcagcctcccaaagtgctgggattacaggcgtgagccaccgcgcctggcccagaaaagaatttttaaaagtcccagctactcaggaggccgaggcaggaggatcacttgagcccaggagttgtaggctgcagtgagttatgattgagccactgccctccagcctgggcaacacagtgagaccctaacaatcaatcagtcaatcaacaaaataagaatctggccaggcacggtggctcatgcctgtaatcccagcactttgggaggctgaggcgggtggatcacctaaggtcaggagttcgagaccagcctggccaacgtggcaaaacccgtctctactaaaaatacaaaaattagccaggtgtggtggcgggtgcctgtaatcccagctactcgggaggctgaggcaggagaatccattgaacccaggaggtggaggttgcagtgagtggagatcacaccactgcgctccagcctaggtgacagaacgagactccgtttcaataaataaataaataaatataaaaaataaaataaaataagaatcttatgagtcccagagagagagagagagagagacaaagctcttcctcacagtaaaatcccaggtatatgtgtaaaagaaaaatcattatttggccaccatcagagtagttattgcttcaggcaagaatcaccaatgaatgctaaagtagtgagtaaaagtttgatttaaaaaaaattgcagagttacagtctcaaagtatctcccgaaaagctacttattaattacaaaaggggatcatgcctgtaatcccagcactttgggaggccaatgcaggaggattgcttaagcccaggaatccgagaccagcctgggcaacatagtgagactgtttctacaaaaaatttaaaaattagccgggcatggtgactcacacctgtagtccttgaagattacatgagcccaggagttcaaagatgcagtgaaccatgattgtgtcaatgccctcaagcttgcgtaatagggcaagaccctgtctccaaaaaaaaagaaaaaaaattacaaagggaaaaatagtaaatttatactggtgaaaactagaagaccactttaagcaaaagatcaatgctaatactaacaatttcgagactaactgaaccctcctgcctcctgataacgctgagaacacagcgtcacttctgtggaattcctgccaaaaatgcagaattcaaatctaatcatgaggagacatcagataaacccaaattgaaggacattcttccaaagaactggtctgtgctctcccaaaacatcaagatcatgaaagttaagtgaagatggagacattgttccacattggaggagactaaaaaaacctgataacagaatgtatcttgtgaccctatgattcccttttcctatacaaggacactattgacatgcccaccagggtggctagaaccaaaaagtcagataacaagtatttgtgaggatgtggagcaatggaaacctcatactatgctggtagcaatgtaaaaaaagaaaaaaaagtccttgctcttaggatattcatactgaagtatttagttaaaagggtgtcatatccgcaaccactaacaaataattcagaaaaatcactgtatatcattcagaaaaattatatatatgtaaattacatatgtatatacatggggagaaagaaacggacagagacagagagagagcaaatatgttatcattataaggcttggcatttttgtcagtcccataagtgaaaaatagtatatcattgtttttaatttgtatctctttaattatggagagctcatctaaaacaccccagaaaccacaacctagaatgaccacagacatttattgagtgtccaccctctactaagctccagtgataaaaatatgaagcacaacatctggtagatgtaaaatggtattatatctcactgttgttttaattttacatttccctgagcagtaaagagattgggttatcttttcatatattatacatattgaccattttaggtttcttctgctgtgaattacctatttgtacccaatgtctattgccaagtgtattgtttgtcctcttcggatttgtagatgttcgttatatatcctaaaacctagatcctacttctttgtgacacaggtcaaaagcctagatggaaacaatcaagtccgcaaagcccaggagcacatgtggtaagaatcttccagttttaaatgccaagtcttgcaattgagggaagtatttctggtaggtgctgtgggtcattgttgactcaacttgagtgggtttgacaactgagaaaaaaattaaaatgaaatttaattcataaaatgtatgtcctgtattctgctgttaaggaaaagaattgatatttgtgcatctggtctaagctattattccttatatatacatattcttaccgtattaaatgttttttgtttgtaatacatgaatactaatttatgagctagaactccatttaacttcatgttaaaatagagagaaaatatacatttctcttcaattaccattggtgtttcccagcaaaaacctgccaagcccactcttttgtttaacagaaaaggacaatggagacgggtgagtgaacatgacttgcccagctccatacaggccattgttaatctgattaaaatctgtttcagttggctgcccaggtcagggtggcgtccagtttgacctgggcttccttctcccttccacgtcacagctaagcatgtagtgcagtaagcgcccagtaagtgctcttttggaaaaataggcccttcatcagcctaggtacaaaggggaatgcctagaaactgcagcagtagggtaggtagaaggcgggtgctacataaatctttagtgttggtgcagatagaggtgcggatggggccagtgtaagcgctttcttttttattttatttatttatttatttagagaaggagtttcgctcttgtttatttatttatttattttggagaaggagttttgctcttgtcacccaggctggagtgcaatggcgtgatctcggctcactgcaacctccgtctcctgggctcaagtgattctcctgcctcagcctccggagtagctgggattacaggcgcccagctaaattttttgtatttttagtagagacagggtttcgccatattggccagcctggtctcaaactcatgacctcaggtgatccatccgcctcggccttccaaagtgctgggttacaggtgtgagccaccacgcccagtctttatttatttattttgagacggagtttcgctcttgtagcccacaatgacgcgatcttggctcactgcaacctctgcctcctgattctcctgctttaacctcccgagtagctgggattacaagcgtgcgccaccacgcctggctaatttttgtatttttagtagagacggggtttcgccatgttggccaggctggtctcgaactcctgacctcaagctatcctcctacccttggcctcccgaagtgctgggtttataggcgtgagccaccgagcctggcccttaagagctttataaatgccccccttttaagtgctcggtactagcctccctctagttcacagagaacatttactagtcgctggggtcaccttcgaagcaaagagtctgctggggaattaagcatgcaaatcacttctcaacgacgacacgccaagtgctcacagctcgtccccaggggaagcacaggcgcctaatttgtgttcctaggtgacacagtcattacttataaatgttcctggccggtcccaggaggtgggagggttgggagttacttcggttctctcaaaggttggggaaggagagatctcggtttgttttcccatctgtgaaacggggacaccacggtatttagaggacgtgcgcgggtgactatttgggggtgcagcggcttccctcctccctcccccatctttcccttctcacttccaaggcttggaaatttggagattcggaagtttgttcttggatggccagaaatcctccggaggcagacggtctggggctgaaaccgccacaggccggaaaggtgcgggcgtgaacgtcctgcgcgccgacgtccccccgcgccggtctcccctcaatcctcctgctcccctcctccgcgtccccgtccccgcccccctcctgctctcccattggccgagccggcggccgggccgccccgggatttaaagggcccgctcgccgcgccgctctgggagccgctgctggtcccggccttgcggcctgcgggggaggctgcccggaggaggcagcggcggcggcagcgcgtcctcggtccccaggaccacggcttctttcctgccaggtaggtcgccagtagtgcgcacgcggctccccagctcccatccctgggccggcctccccaggcggatctgtagcgcgagtgctaggaccccctccccatcacctttccgactctccctcaggctatgtctcctaccaccacctccttgcagcccccggacctgggcaggactttgttggcggcctctcgccgggtggggatgagatggggggcgcggaggatacaggacaccccccctccccgtgccgccgcatccatacaaggagagatgcacacggcccccaagtgtcacagaatccccctctctgccctccactcagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggtaagtgcctgccataccgtgtgccaccatgccaggccatatcagacctcccacattcatccatatcgagccacaccttaccctgtcacatcctgccaggccctagcatgtccaagctggaccccaacatgttcagccccaccacatcccaccaggccaaaccccattccaccataccacatcctactatgccagccaccccatgccatgccacaccgagccacatcctgccatgccaagccatgcccttcagtattcctgagttctgggattccagaaagctgagattcttggatcttgggattctgaaatgtctacatcccaaggttataagacattggcatgctgatgtcacagggttatggaatcccaaagtaccatgattacagcgtttggagattctgacaatttgaaattctcacattctagacttctaaaatgttggcattgtggatttctataatcagggcatgatgcgatttctggattctaggattctgaaatgtttccacagtcatagcaggcctgtatcttaatgaaagattccaagtccccaagattcctataggaggcggagatttctggaaatctgagatccgaaggttctacactttcttttttctttctttcttttttaattttaaatggatgttctattttttcccaggtttattattttgaaatttttcaaagctactgaaatgttgaaaaaatagtacagtgagcacccacgtatgcatcaccagattctctgtcaacatcttgccacgttagctggctctatctgtctatctatctatctatctgtatatctatccatctatctatctatctatctatccatctatctatctatcatcttcctgaattgcctgaataacctgctgacatcatgacactgtaccccacatccttcagtgtgtggcccctgagaacaaggacatcatctcccacaaccacatcctccaccatcaccccacaagacattgaatctggatacaataatgttatcctatataaattgatatttgaatttcttccaaggtcccccaaatgccctttatagatgtttcttttctttaaacccaggccctgccaccctctccagctccccaacacctgctttgggcccctccaatcccactacattccagcctgaaggcctttgccctggctacgccctctacccaggtcatcctccccttcctactagcccaccaaccttctctttcttgttctccctctctctctccctccctccctcccttcctcccactccctctctttctctctctttctcgttctctctctccctttctttctccctttcacccaaagggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatggggtatgagtatgcatccttatcctcacactgttggctgaagtgcatgggtgggtccccaggccccatatgaagttgtccaagacagggagggtggtgagattccccggagaaagaagggagtctgggagaatcatttgcctatgaggagacacagaacaggtaggacgtggagtgtccctggagaagggaatctgggagatttgtcctttcacaggactgtaagggacaggttgggcatgggctccccctggaggagggagcctgggagaatttttccaccatgagactgttgtaggacaggaggaggtagaaccctctgggcaccttggacccccttcccctgtcccccatggtctcagaggccatgagtgtcatgggaccaagaccagcacctttttcctcagtgagatgcacatggtagacaccgtgacatggcacaagatgcgaggtaggtagccctgcccctctcacctgcccaacccccctgccccactcctcgtctcctaactgcccccaccctgtgcctttcctctcctgcttttctccctcacctgcccaccccactggacgtgcagacctcacattactcttgggtccgtgtctctttccaccgtgcattttcccgaagtctgtctgtctcgtgtcatgtatgtgcctgactctctggagtaagggcatctatctgtcctgggcttccttgcccacctgcctatctgtcccatgcccacctatccatccttgtgcccgcttttcctaccacatctcacctggtgcacctcctccttgccatgctgatctgctctctgcccatccacttgaccatgggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactggtgaggtcctgagtggatgggtgggcagggactgtgggagccaccctggggcagcactcatggagtgcttgatccctacagagctgccggtggctgcagaaggtggcccggagcctggcactggccctgctgtgccttgtgctgtccacttgcgtgggcccctacctcttcccgtacttcatccccctcaacggtgaccgcctccttcgcaagtgagcacagccttcgaggcccctgcccagcaatgagggggttgggtagggacccgcggtttccccagttctgagcctgtctcttaatgcttctttctgtcttctgttactacagcaagaaacgcaaagccaggtaaatgagggcaggtgtgagggcacgtggagtggggctgacatgagtgggggcagagcccatgaccaatgggttctgtgtgtccaagtgtgtctgaccgtcaactccatgactagacagagactgtggttggctggctggctgacgaagcttggctctgtgactctgtttgactgacactccaacacatactgtctctggctgtccatctgttcagctgtctcgctgttagaagcaagtcatattaactgtcatggagagtgacaagtatgtgttggttgggtgactttaacctgtcagtgactctgtctagggatatgtatgatgtatgtttgtctattggccactgacccccgaatgtaagcctgtgtggctgtctggctgtgccatcatcagtgatagggtatgtggctgtcattggataagataaatctgtgttcaagattctgactttttgtagctttggccaggaatgggtctgactgtggcatgtcatatgcctgtctgtggagttcatggactacctctgcctgtgtgtctgccttccctgatggcttggtgttgtctagctgaggggttgtacccgactctggtctgtgcctgtctgcaggactgactgcctctagtttgactatagggtttgatctggctctttggttgtatggcccctcccctactccctggctgctgattaggtctaatgccgaatgagtctccaaaaggtcaagtgacttgaccagtgtcacccagctaagcagccaggcatgaatcccaggcctaacttcagaacctatgctttttccaacgcaggatgctgcctgtttttgaccatgtctgattacaactagtagggggggtgtgtgtgtgcacagcagggtgtttgatggtctctgtgcccagctcagggatttttggctgtcctgtagtcgctgagtcaggttagagcattgcaaggctgggagtctgataagatttgtgtctggctgttagagggtgcaggtctgtgaagtcgggcctctgatggtggctggctttggccgtctggccacgtgagcctgcagggccatgccatattataggatagctcatgcatccatttgagccacataagactaactgcctgagggtggatgtctgtgtgtgactatcatagttcaccttttttgtggctacatttcatctgtcttgtctgaacaattcagaccagcctccagggcctctctgactctcttttctttcttctctgctgccttcctgacccctgggggccctaggggcaccatggtaaggtgagtctacagagcggggcccaggatgctgacatgtggtggggtatcatgttgggacctgaacgtgatgcctctcacccctgcccctttctccccaggtggctgcgagcctacgagagtgctgtctccttccacttcagcaactattttgtgggctttctttccgaggccacggccacgttggcgggggctggctttaccgaggagaaggatcacctggaatggtgggggggcttggggaccccctctcccacagggtgctgcctagaggagctgcagggaggagggcgggtgctcccaggggagggaacggccaagacagaagtgtggcggtcagatgagttgagatcccaaatggatttgcatatctcttctgcccccagggacctgacggtgtccaagccactgaatgtggagctgcctcggtcaatggtggaagttgtcacaagctggaacctgcccatgtcttattggctaaataactgtgagtcaccaagtcaccactccagctgtgttggtaatccaggccctttcatacattcatacaacatttactgagcaccttctgtgtgctaggcacccaaaatccctacccttgtcgagctgcagttctcctgggggggcagatgataaatacgagaaaaaaaatacataatagctcaggtgttgataagtgctatggttaaaaaaaaaaatttttaaaaaagcaggtaaaggtgatccaggagtgctggcaggagataggagtggggagggtagggtattgcaattgtaaaaaaattagccagggcaagtctccctgaggaggtgacattggagcaaagatgcaaaacaggtgagggagcagggagcgcagatatatgggggaggattgtaacagatgcggggacagcaggtgcaaaggtcctgaggcgggaacttgcctggtgtgtggggaacagcaagaaggccagcagggcaggagcagagtgagccagggtccagtggcaggcggtgaggtcagggaaggcccggagggcctcatgggccatggagaggactttggctttttctctgagagagatgagagccacggcagggctctgagcagaggagggccctgggctgactcgggttgcagcaggatccctctggctgctgtgaggacagactgagaagagggatcgaggatgcagcagtgaggaggccgctgccatcatccaggccagtgatggtggtggtggcagtggatgtggagaggagagctcagattctggcatattctgaaggtggaactcacacaatttgctgaatttggatgtgggagtttggggagggcaaatcaagggtaattcccaggtttttgccctgaggaactggaaacgtggagttgacattgactgaacttgatgagactgggaggagcaggctgggaagatcgggagctgggctttgggcatgtgaagtttgaggccatctaaggactttatcctgggggctccaacaggttgtgggtattctcatcctgctgatggccctccaggaggggctgggggactttcaggagaattttatcccacatctcttcccctccagatgttttcaagaatgctctccgcctggggaccttctcggctgtgctggtcacctatgcagccagcgccctcctacatgtgagcagggtggagcaggatcagggtggaagctgggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaacctgacccccttacctctccccaccaccctagtcctccggaagcgcctggctcggatcctcagtgcctgtgtcttgtcaaagcggtgcccgccagactgttcgcaccagcatcgcttggtgagggttcagcctgggcaaccttgtgcccaacactccctgtcaaaaatgttccttctatctctatcttgtatgtgtctcagggtgcccaccttcttcttttggtgcctgagccatccccataacctctcctctattcgctggcatccgtttccctaacaggcatttatcgagcatctgctgtatacacacctggcattcgtttcccccagtgaacatccgttgagtgcctgttggtgctctaggtgctggagacacggtgaatgaaacagactgaagtcccagccctatgggacaaacattttaaccgggcagacagtagataaaaaatgagtcagtaaagtctaataatagtgtgtcagattgcaagtagtgctaaggagaaaatgtgtagggcaaaggggacgggaagtatgggggtgatttccatttgaaatagggaggtcagagaagcctccctggtgaggtgatgtttgaggcctttaaccgaaggaggtgagagagggaaacgttccaggcagagagacacccagtggaaaggccctgaggtaggagagggcctggaatctttgaggaatagcaaggcagccagggtggcttgagcagaggtagggtgaggaggggagatgggtgggaggcatgggccctctagatcatggtggggatttggttttgttgtgtgtttttcattctgtttgcaataagaagtacagacaacttcatacttgtctcccacccaactcccgttcattactataaagccctgactcaaagccctgccactcttcctcctctgcctggagactcgcacctcccccaacccaggatgccctcactgtgaacagtaccctcatcttggatgcctctgcataggaggctccctgaaccatctcttccctatctcagggggtaccctgggcatcctcagtcctggaacccactgtgccctgtgtgtcccctgggctcccccgtgcaggaggaggtgggacacagtgagtaggtccagttgccaagtatatccatctgtcccccacagggcctgggggtgcgagccttaaacttgctctttggagctctggccatcttccacctggcctacctgggctccctgtttgatgtcgatgtggatgacaccacagaggagcaggtgaggtggggccctgggctgtgtggttaaccaagggtggcgctatctggcggggggaaaccatgaggacaaaggctgggaagctgaggcctgagctcctcagactgtgctgcttcgcctgggcagccagtgctcctcggtcctttcccatagtccctctgcttgagtcacactgttaggtcttttatttgggtgaagtgtgcaaaatatgtttatttattttacttataaaataacttttaggctgggcatgctggctcacgcctacaatcccagcactttgggaggccaaggtgggcagatcacttgaggtcaggagttcaagaccagcctggccaacctggcgaaaccccgtctctaccaaaaatataaaaaattagccaggcgtgatagcatgcacctgtaattccagctactcgggaggctaaggcaggagaatcacttgaacccaggaggtggaggtcacagtgagcccatgccactgcactccagcctgggcaacagagcgagactctctcaaaaaaaaaaatcactttatagagatggagtggaaaatccaggttttacttgtgttaattatttcacttcattattgtttaggtagaatttgcaagacttcttaattttttttttttttttgagacaaggtctgtcacccaggctaaagtgcagtggtgtgatcacggcccactgcagcctcacattcctgggctcaagccatccttctgcctcaacctcctgagtagctgggactacaggtgcatgacactaagcccggctaatgtttttttaattttttttgtagagacagggtctccctatgttgcccaggctggtcttgaactcctaggctcaagcaatccccttgcctcaacctcctaaagtgctaggataacaggcatgagcaccctgttttatttaatttaaatatatatatatatttttagacggagtcttgctcttgttgcccaggctggagtgcaatggtgcgatctcagctcactgcaacctccgcctcctgggttcaagcaattctcctgcctcagcctcctgagtagctgggattacaggcacgcaccaccatgctgggctaatttttgtacttttagtagagatgggatttcgtcatgttggccaggctggtcttgaactccaggcctcaggtgatccacccgcctcagcctcccaaagtgttgggattacaggcgtgagccaccacgcccggccaaaaaaatatatattttattttacttaggttgagtgtacaaaccctggattctgcactttaaaatttttcgttaaaatgtatgcactatttttgttcatgttgagtatgcaaataccagattttactcctttttaaattaagaacaatttaaaaataacatttattcatatggctcttgcagaatccaggtttttgcttctcttttagttaggtttcagtcaaaaacaaaactttgtgttttttgatattaaaaagtttttaattcaggttaagtgtgcaaaatctgggatttgcttttcttttttttttttgagacacggtctcactctgttacccaggctaaagtgcagtggcacaatcatagctcactgcagcctcaaactcccaggctcgagcagtccacccacctcagcctcccaagtagctgggactagagatgcatgccaccacacctggctttttgcttctttttaaataaagtttttgttttgttttcattaaaatattttaaaatagtgaatgcctatcatgtgcttcaaaaaccaaacagtattcaagatatttagagaaaagatttgctcccaccctctgccccctaccctcttacaggttacatggtgagacggggtttcaccatgttagccaggctggtctcaaactcctgacctcaggtaatccactcacctcagcctcccaaagtgctgagattgcaggcgtgagccaccgcactgagcccacttttatccttttattaaaatatctttccaaaatttaagcatatcaaacaaatataaaaatatattttaattctacccccttgccagtttttaccctaaagataacacatgaatgatactgttctgcaatttttgaaaatcttccacatcaggatatagtgtcctcattcattttttccactatgaggaagtgacacagtttattttttctcttatttgtggacatcaggtaatttctagtcctttcctattgcaagtgatgttgcagcaggaactctgtacccaagtggatccacacaggtgtggacagatctgtaggatctgttgatagtctcaatggagtagtacttttgtgctctcccaccagcaatgcctgaatgtgcctgctgccccaccagtacagagtgcctctcagacttcctggatatgtttgccacttcaataaagaggaagatggccgggcggggtggctcatgcctgtaatcccagcactttgggacgcccaggcaggcagatcacttgaggtcaggagttcgagaccagcctgaccaacatggtgaaaccccatctctactaaaagtacaaaaattagctgggcatggtggtgcagcatctgtaatcccagctactcaggaggctgaggcaggagaatctcttgaacctgggaggtagaggttgcagtgagctcagatcgtgccactgcactcaagcctgggtgacagaatgagagcctgtctcaaaaagaaaataaataaaatgaggaagattattaatgaggctgagcatcttttcatatgtttaagagccatttgtttttcctttactggaatgacctattcaccttctctggcaatttttctttccaaaaaattaatttttaggagctctttatatattagggagataacaggtcagagaatgggatcactttgtttttaaaatgatttttaaagaagaagacaaaaactatatctggtcacctttcatatgtacctaggcccttctgcggggcctcgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggaggcctgattggctggaaaactgaaggatccccattctgattggttgctctgagtgggacacagaggagagaaagcaagagagatgaagggttggtgcctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgagacagagtctcgctctgttgcccaggctggagtgcagtggcatgaccccggctcactgcagcctctgcctcccaggttcaagcgattctcctgcctcagcctcctgagtagctgtaactacaggcgcacgccaccacacctggctaatttttgtatttttagtagagacggggttttgccatgttggccgggctggtcttgaactcctgagctcaagtggtccactcgtcttggcctcccaaagtgctgggattacaggcgtgagccaccgcgcccggccttcttttttagaggcagagtctcagactggagggcagtgatgtggtcactgctcacttcagccttgaagtcctgggctcaaagcgatcctcctgcctcagcctacctactagctgggactacaggcctttgtcaccacacctgactgattttcttatttttttagagacagtttcgctgtgttgcccaggccggacttgaattcctggcctcaggtgctgctcctgcatcagcctcccaaagcactggaattacctgccacggtgcctggcctttagtcatggtcttaaaacagaatgtaggccgggcgcagtggctcacgcctgtaatcccagcactttgggaggctgaggcgggcggatcgtgaggtcaggagatcaagaccatcctggctaacacggtgaaaccccgtctctactaaaaatacaaaaaattagctgggcgtggtggcaggcacctgtagtcccagctactcgggaggctgaggcaggagaatcgtttgaacccggaaggcagaggttgcagtgagccgaggtcgcaccactccactccagcctgggtgacagagcaagactccgtctgaaaaaaaaaaaaaaaaacggaatgtaattagaagtgttacaatcctgtctgttaactggtaaattcggtccatttacatttctcatgataataaactatttgaatttgattttattatctcattctgtactttctatttgtccaggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctgtgagtcctgatttctttcatatgctgtgggatgggatttgctgggcagggatcggcttgcatgtttacctatccacctattcttcttccattgatttattttaaatttttatttaatcttttaaaaaatttattataggccgggcacagtggctcacgcttgtaatcccagcactttgggaggccgaggcaggtggatcacttgaggtcaggaatttgagaccagcctggtcaacatggcaaaaccccatctctactaaaaatacaaaaattagccaggcgcggtggctcaagcctgtaatcccagcactttgggaggccgaggcaggcagatcacgaggtcgggagttgaagaccagccaggccaagatgatgaaaccccatctctactaaaaatacaaaaattagccgggtgtggtggcacacgcctgtaatcccagctactagggaggctgaggcaggagaattgcttgaacctgggaggcggaggttgcagtgagccaagaccatgccattgcactccagcctgggcaacagagtgagactttgtctcaaaaaaaaaattattatgtattgttattattattctttttgttttttgcccttctctaaaactggtagataacttatttttgagacaaggtcttgctctgttgcccaggctggagtgcagtggtatgatgattgctcactgcaacctccaactcctgggttcaagcgatcgtcttgcctcagcctccccagtagctgggactatactataggtgcacacctttatgcctggctaatattttcacttttttgtagagacaaggtcttgctatgttgctcaggctgttctttaactcctgggctcaagcaatccttccacctcagcctcccaaaattctgggatgacaggtgcgcaccaccgtgcccagccttatttaacttttttgttgcatgtatattcacgtgggtcaaaaaaccatttaaagagatttgcagtgaaaatctgctttctatccactaagtttccccaaacgctgttaggcactgttgatagttgtttatgtttcttttcagtttatttacacacgtaagtctcaatttgctcaattgtaaaaggaggataatagtaataaccaactatatgtaagatacttagaacagtgtttggcaaacagtggttgccatgtaactgttcactattattatcattatttgcacttttccctttttacacaaatggtaatatgctatatatacttctaatcttttctctttttctttctttccttacaagaaaaccaaagaagccattttcttttttgagacggggtctcgctctgtcacccaggctagagtgcagtggcatgattatagctcactgcaaccttgaactcctgggcaatcaagcaatcctcctgcctcagcctccctagtagctgggattataggcatgtgccaccccaccaagttattttttttttaacaacttttttttttaagagatggcgtcttgctttgttgcccaggctgttctccaactcctggcttcaagtgatctgcccacctcagcctcccaaagtgctaggattacaagcatgagccaccgcacccagctgctttttttaatgaggtcactcctcatgatttcataaagagctttcaaagcatggacattgtacagttgcttgacttgtgtagtattgatgggcattttccctcaatcttctgccattataaacaaggccgggcagagtggctcatgcctgtaatcccagcactttgtgaggcgaaggcgggcagatcacctgaggtcaggagtttgagaccagtctggccaacatagtgaaaccccgtctctactaaaagtctaaaaattagctgggcgtggtggcaggtgcctgtaatcccagctactcaggaggctgaggcaggagaatctctgggacctgggaggcggaggttgtggtgagctgagattgcgccactgcacactccagcctgagcgataagagcaaggctccgtctcaaaaaaaaaaaaaaaaaaaaaaaacattacaggcatgagccattgtgcccggctggtcagatgtttcttaaattttagtcattccagtagatgtgagtgatatctcattatggttttaatttgcttttccttagtgactaatggaagtttgaacatctttcatatacttattggccatttagaaatcctctttgtgaagaacctattcaagtcttctgcctattttatattggatgatctttttctttctttcttttttttttttttttttgagacagggtcttaccctgttgtccaggctgagcactgtggtgctatcatagctcactgcagcctcaacctcctgggctcaagacatcctcccactgcagcctgggactgtaggcacgtgccaccacgtccagctaatttttgtatgttttatagagttgggggtctcactatattgttcagactggtcttgaactcctttatgcaagccatcatcccacctcagcctcccaaagtgttgggattacaggcatgagccatcgtgcccggcggtctttttctttctgattctctgctcactcttgtattcactcatctgttcacctacattctctctctctcattggctacttcactcactccatcatctacacctgcttccttttataccacacacacttcttgagtaccaatcacagccacactgttttgtgtcaggctttacacatattaccttgttttagagaaataaaccactagaatccaaacagttaccccatttcacggatgaggaagcagacgcatgggaaggttatgaagtctgtcttcttgcagggacccccagctctcacaagtgtgtgttcctttcactgcctttattcttcatatctctctcttcttttcttcagggaaagagtatgccaagggagacagccgatacatcctgtaagtgtttgcctctgtcaatggagactggcattggttttcggggggtggtgagttggggagcactaatgggctaacctgtaggaagagcacaccgataccagtgtcccctcatgctttctcctgcaggggtgacaacttcacagtgtgcatggaaaccatcacagcttgcctgtggggaccactcagcctgtgggtggtgatcgcctttctccgccagcatcccctccgcttcattctacagcttgtggtctctgtgggtaaggaaagggcactagaggggcactgggcactagaggggttgatgggggatccacagacacagatgtatccctgtgggtgggatctctcaacggtgcccttccaggggtaagtcagactgaatgacaaaccccctgaggctctggaaaggtcatgcccttctctgagcctgcactctcaggtggggagggttcatttttcttcctcctcctccttctccatcacaaagtctcctgtgaaggttacatgaggtggcccagggtggcaagaagcccctggaacctccaggatcagggctctgagatcccttcatgtaagattctgtcatattttttttaaaacagggtctggctctgtcacccaggccagagtgctatggtgtgatctcggctcactgcaacctccacctcccagactcaagcgatcttcctgcctcagtctcctgagtagctgggactacaggcatgtgccaccgtgcctggctaacttttgtatttttagtagagatggggtttcgccatgttgcccaggctggtctcaagctcctgagctcaaacagtcctcctggcttggcctcccgaagtactgggattacaggtgtgagccactgtgcccggcctcagtcatcttgtgttattaaattgttagctttctttagttctagcgatatgagttatctttagtcccagaatcctaagctgtcttggatttgaggattttgaacttccttaaatctgaaggtgtgagctctcctgagttctgaaattctcagctctctggtgtctggaatctcacttttctgatttctcagattttcagctctgtgatttcagaatacttagctctgagaccttgaatgatgacttggaaagtgctttggaatagagaattggcgaaagtgtccccttcctcactggggcttctccttcccctcctgccacccacaggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaacactgagagatccttaattactaaccccagagatgcgctatgactgaccccacagatcccaccatcattcacttattccagacccccatcagcatctaaagacctcccacctctgacctcacaaacccctatcactgaccccccgccagaccccataactcactacacagaccctatcactggccccacagtcccctggtcttaactcgagctgccataacagaatgccacagactaggcttaaaccaccgaagttcattttctcacagttctggagtccaagatcaaggtgtcagcaggtttgacttctcctgaggcccctgtccgtagcttgcaggtggccaccttctcagtgtcctcacatggtctctatgaactagcgtccctgtccctggtgtctctctgtgtgtccaaatttcctttttttttttttttttttgagacagggcctcgctctgtgtcaggctggagtgcagtggtatgatcatggttcactgcagcctctacctccctggctccagcgatcctcctgcctcagcctcctaagtagctgggactacaggtgtgcactaccacacatggctatatttatttttttttatagcaatggactctcactatgttgcccaggctggtctcaaacacctgggctcaagtgatcctcccacctcaaccttccaagtaactgggacaacaggcacatgccattatacctaatttttgttttgttttttttttttgagacggagtttcactcttgttgcccaggctggagtgcaatggcacgatcttggctcaccacaacctctgcctcctgggttaaagcaattctcctgcctcagcctcccgggtaggtgggatcacaggcatgtgccaccatgctcagctaattttgtatttttagtagagacggggtttctccatgttggtcaagctggtcgcgaactcccgacctcaggtgatctacccgcctctgcctcccaaagtgccaggattacaggtgtgaaccaccatgtccggcaatattttttcaattttttgtagagatggggtctcactatgttgcccaagctgatctcaaactcctaggctcaagtggtcctcccacctcagcctcccaagtagctgagactacaggtgtgaactaccatgcctagcccaaatttccttttatgaggacaccatttgaccagcctgggcaacatggtgaaaccccatctctacaaaaaaaattttgaaaattagctgggcatcatgaggccacggtgggaggatcatctgagctagggaggtgtaggctgcagtgagccatgatcacggtgagagcctgtcttaaaaaaaaaaaggaggtggggggtgggcaccagtcaggcacagtggctcatgcctataatcccaggctgacacaagtggatcacctgaggtcaggagtttgagaccagcctggccaacatggtaaaactccatctctactaaaaatacaaaaattagccatgcatggtggcacatgcctgtaatcccagctacttgggaggctgaggcaggagaatcacttgaacctgggaagttgaggtggcagtgagccaacatcatggcactactgcactccagtctgggcaacagagtgagactctgtcccaaaaaaaaaagtggggggcaccatttgtattggattaggcccactctatgagtcccattttaacttaaccacccttttaaagtccctatctccaaatatagtcacattctgtggtattgggggttagggctttaacatatgaatttggggaggacacagttcagtctataacattctgctctctctggcctcccagaattcatgtccttgcatgcaaaataccttcacccccatcccagcagcccaaaactctcttttgtttttttggagacagggtcttgctctgtggcccaggctggagtgcaacggcacgatctcaggtcactgcaaccacagggtttcactatgttggcctggctggtcttgaactcctggcctcagatgatccacccacctcagcctcccaaagtgttgggattataggcataattcactgtgccataagccactctgaaagctcttaatcaagtctagcattaactttcagtcccaagtcttacctaaatatcatccaaatcaagtgtaaatgagactggaggtatgattcatcctgatgcaaaaattcttctctagctgtgaacccgtgaaaccagataaatcatctgcttccaaaattcagtggtaggacaagcataagctagatagatatttccattccaaaaaggagaaatcacaaagaagaaagggatcacagtccaggcgtggtgactcacgcatgtaatcccagcattttgggaggctgagatgggagggtcacttgagcccaggtatttgagaccaccctgggctacatggtgaaaccccgcctctacaaaaaactaaaaaattagccaggtatggtggtacatgcctatagtcccagctcctcaggaggctgaggtgggaggattgattaagcccaggaggtcgaggctgcagtgagccctcttctcaccagtgcaccccagactgggcgacagagcaagaccctgtctcaggagaaaaaacagggatcacaggttccgaataagtttgaaaccaaatagggcaaattctattagatttttaaggcttgagaataatcctgtttggctctatgttctgtcctctgggcccaccagattgggggccccactttcctggttcactggagaggcggtgtctctccctgagccctgggtggcagcctggcccactgaaacagaggaggcctctttgccctctggaactgaggaggagacagccccacctttgggatcattctccctttttcttgaagtataatgcatgttcacagccagaaagctctgttgtcgtgtcctgttgaatcccagaagtcctacagtcttctttcattttgtcccatctctgtcctctttagtcccagctggccgtgtttctgctggtattacccatctgtattcctggcttctgccaagatggctgattaggtcagtgagtcacacccatgatctctttgtggcatgattgtttagccacaccctttgtcttctcaccagaacacattctcagcttttgcagtgttggataggctgagaacttttttatcttcacattcgagttcccttctgcctgacaatttcttttgcaatttctctctttcctcttgcattctactagaagcagcaaggagaaaaaggccacataatatgctgcttagaaatctccttagctaaatctcccaagttcgcctctcacaagttctaccttccacaaaacactagaatacaattaaccaagttctttgccttccctccattttccaataacatattcctcatttccttctgaggcctcaccagaagcactttcaacatccatatttctaccagtagccttcaagataattgtcttagtcatttggactgctctgacaaaatactataaactgggtagcttataggcaactgaaatttatttctcacagttctggggtctgggaagtccaaaatcaaggtgttggcaaattcagtgtctagtgagggcctgcttcctcacagatggctccttccctctgtacccttatatggtgggagggtagaactccggtcccttcatcccttataagggaatgacctaatcacctcccaaaggccccacctcctaatatcattacactggggattaggtttcaacataggaattggaggttggggggacacaaatattaagatcatagcagcaacataggctttttctaacatgcacctcaaaactctttcagcctctacccattacccagttccaaagctacttccatgttttaggtatttattatggcagcaccccacttcccaggaccaaaatctgtgtcagttttctaaaactgccataacaaaatgccacatacctggtggcttaaacaacagaaatttatttcctcagagttctggaggcggaaaatccaagttcaaggtgtcaaccagtttagtgtcccctgaggcttgtagatggtcaccttctcgccatgtcctcacacagtcttccctctgcctgcgcatgtcggtgtcctaatctcttcttatagggacaccagccagagtggattgggacccgccttcaccaacttcattttaacttaatcacctcttgaaaggccctattttcaaatacagtcacattctgaagtattgggggttagggcttcagcatgaattttggggagataccattcagtcagtaataccgctctgtgctcaccccactcactccctaatacttagcctcacagatcttccatcattcaccccacaaacccccatcacatgccctgattactcagcccacagattcccctgcattgctgccacatggacccccccaacacccaccctatagacttcccatcacaaaccctaaagatcccccatcactcaccccacaggccctatcgtgaaccctacatattcacgtcattcacctcacagagccacattactcatccaacagactccacccctggatcattcagcttattggcccctaatcacttcactcactctacagactcactcatcactgactctacagagctctaatcactcatcccattgacaccccattactaaccccacaggtgcctcccactcatctcacaggccctccatctctcacaccacaaagccctctcaccttatgagctagcacatcagcacccctacagacccccagtcattcccccaccccacagatgcccccgtcaccccatagatcctcatcagccatctacagatcccccattcctcaaagtcctccttcactccccctacagacttgccccacagcccccatcattaatcccacagaatcctgccactcgccactcaataccccattcactccacaggctcctcatgaccctacagaccccgtcactaccccacagatccctattactcagtttattatcccctgatcataccttccagagaggccccatcgctaaccccacagaccctaatcctcccctgtgttagtcggctctggcttccgtaacaaaatgccacagaccaggtggcttaaacaacaaacagtttctcacacttcgggaggttggacagtccaagtgcaaggtgccatcagggttggtgtctggtggggtttctctccttggcttgcagatggctaccttcttgctgtgtcctcacgtggccctttctctgtgcactcatgcccagtgtccctcttcttataaggataccagttctactgaattagggccccacccttataatctcatttaaccttaattacctccttaaaggctctatttcagatatagtgacattatgttgaaatattgggggctggttcccctgatattagggcttcaacatatgaatttggggaggaggacatcattcagttcatgacactccccatcactcaccccacagatgccacagctctcacctcacagagcccccaacactcctaccacatatattccatcactcagcctcttggcttctgataagccaccccacagatcccccatcactcttcccacataccccatcaactcctaagatacccatcactctccctaccaacacacattcattcgtttcacagattgcccattattgaccccacagaaaccccgtaactcaccacacagacctcaaccccatcactcacccccacaggcccctatcacccccaaaatcttcactctgaagatcccataactcaccccagaagcccctcatcagtcaccctaacaacccctatcactgacaccacagacccaccactcatcctacagatgcccctttactaaccctataagcatcccataactcaccttgcagaagccatcactcaacccacagagtccatctctcatcccacagaccccttatcactcacaccaccatcccatctctcaactcacggtcctccacaatccaccatatacaccccatcactcacccacagatgccatcattcacccctcagacccccatgacttacctcatagtgcacctatcatgtacccacagactcccatccaccccagggatcctccgtcactctccacagacctgctattattcacccaacagacacccctcacttactctacagacccccatcactcatcctgccgtctatcattaccttatagaccctccatcataaaacaactgggtacttgagaagttttgaagagatggaaaagaataaataataaaaccacagatacctgtagactggcttcaagtgacctctgtaaggccgggcacagtggctcactcctgtaatcccaacactttgggaggctgaggcgggcagatcacctgagggttgggagttcaagaccagcctggccaacatggtgaaaccccttctgcactaaaaatacaaaaaaattagccaggtgtggtgccaggcacctgtaatcccagctacttgggaggctggggcaggagaatcacttgaacccgggaggcagaggttgcagtgagctgagactgcaccattgcactcaagcctgggcaacaagaacaaaactccgtctcaaaaaaagaaatatcaagtgacctgtggacttcagttcaaatcctggctctgcttaggcctacagtatatagctttggagaaatgcctcactgttaaggtcaaagccctgcatgatctcactctattctcacctcgtctgctgtcactcacctatcattcactctacttaaaggcatgctgacttccttgcttttcctcaaacacaacaggcatagccccaagttccatccattgcactgcctactctctgtgacactaccccctttgaccttgagcttgtttctccctggctttcagtactctaatctgtagaatgcttagagtaataacacctacctgctatggttcgaatgtttctcccctccaaaactcatgttgaaactaaatctcttttttaacagaattaaggaggtgggaaatctgactacggtatttgagagatgggaccttgagcggtaattaggattagattagatgaggtcataagggtggggcattagtggttttctaagaggagaaacagatctgagctagcaaggtcagcacccttaccatgtgatgccctgctctgcctcgccactccacagagaggccccaccagcagaaggccctcaccagatgtgactccttgaccatggacttcccagcctccagaactgtaagaaataaatttcttttctttcttttttttttttggtggggggggggtgttgttgttgttgttgtttttagagacagggtctcactctgtcacccagactagagtgtagtggcatgatcacagctcactgcagcctcaaacttctgagcataagcaatcctcctgcctcagcctcctaagtagctagtactacaggcatactgccatgctcagctaatttttaaatttttttgtagagacagggtcttgctatgttgctgaggctgttttgaactggcctcaaagcaatcctcccacctcagcctctcaaatttctttataaattacccagtcttgggtatttgattatagcaacagaaaaatggactaagatactacctcatagggtttttatgcagattataagaattaatttatgtagactgcctagcatatactttatatttgttgaatggaagaatgaataaacaaaaaagaaagttctccccaggactatggcaaggacctcctttttgatctccttgcttccagtatctttccatccaaagctctccccaggaccaagacagaggcatctgaccacatcatacccctgtctaaacctttgccccagtgtccttaggatcgattccaaactccaggctaatggtttgcacatcccaccctatgataaatgaaaagcaggctcttactccttgtttccatcagaaaatccagcagtgctataagtgattttgactctaaacacatggggcaagagagacatgccaataatccttttctggctttcagagaaaatccccattatttataccttctaaaaatagagatatctatttaatgttaataccaaggcaacatgttgtcttaaaagacaccaaaatagaattgcagacttacctaaaaagttaaccttgagggttgcgtccatatgacacggacacaatagttggagtgctagtatcttacaagactcctttgttggaaataacatttgtttttgttttttgtttactttttttttttgagacggagtctcgctctgttgcccaggttggagtgcaggctggagtgcagtggcggctcactgcaagctccgcctcccaggttcacaccattctcctgcctcagcctcccgagtagctgggactacaggcgcccgccaccacgcctggctaattattttgtatttttggtagagacggggtttcaccgtgttagccaggatggtctccatctcctgacctcgtaatccgcccgcctcggcctcctaaagtgctgggattacaggcgtgagccactgtgcccggccagaaataacatttgtaagtgcagcctgtattttgtccaaaccgcacggatgttgtgcaattaagtgggaagactgcctttttgcattttgccacatataaagtttctcagaagagtctaagatatattcaataattcagccaatatctagtagacatacaccatttaagaacaggaccaaccttaacatgttatgaagattaggtaagacaaaagcaaagttttgtgggcttttttttttttttaatcaggttctcactctgtcacccaggctggagtgtagtggcgtgatcacaactccattgcagcctggacctcccaggctcaagtaatcctcccacctcagcctcccgaatagctaggagcacaggtgcgcaccatcagacccagctaattttttttttttaattttgtagggacagggtcttcctatgttgcccaggctggtctcaaactccccggctcaagcgatcttcccacttcggcctcccaaagtgctgggattacaagtgtgagccactgtgcctgactcagtttattttttaaaatttttcttcatttattcttggcttcttccattcattgttttgatcactaactatgtgctcagcacattgctgagccttttgcatgctctgctgggcattccccatttgctcttccggatccattatccaccctgctctgggaccccaaaaagctgatcttttatagatggtatcatttgggccccattgattggttcgtagttgagcctggccacttctctttcaactggtccctggcagtcagtaccaacattttagtcaggtttcaaagaaatctctagaccaagctggacagagggcttttccagtgattcagtgattccccaagatctgagaatgtgaaacttggaaaagggacacaaagaccggggatcctttgagctggttcaataatggcagagctttagagatatgctgctgagctccctgggtctgtctcgctttctgccttctgaaggcttgattgttaacttcttcctgggtttcaattagaagcattagtgtccttcctggagttgaattacctggaaatttgcctcctagatgtgtaaacttgggaaagtatgatctcgtcaagtttcagacaaaggcaaactaaaaagctagaactccagagagcataatagtgttttttgggggcaaattatttaatgaagtataacattcatacaggaagtacaaaaatcatcagtgtacaaaatctccatgaattttcacaatgtgtaaaccattttcctgttttatctgaccttactaagtcagggtataaattattaattttttttgaaacagggccttgctctgtggtgcaggttagggcagtggtgtgatcaccgctcactgcagccttgacttcctgggctcagccatcctgccgcttcagcctcccgagtagctgggactgcaggtgtgcgccaccacgtccagctaattgtttaattttttgttagagacggggtctcgctgtgttgcccaggctggtctagaactcctgggctcaagcgatcagcccgcctcggcctcccaaagtgctgagattataaggcgtgagccactgcaccctgctgagtatatttttaaaaacactttacccgagggctgtggctcacacctgtaatcccaacactttgagaggccgagacgggtggatcacttgaggtcaggagttcgagactagcctgggcaacacagctaaaccctgtttatacaagatatacaaaaattggctgggcgtggtagcacgcgcctgtagtcccagctcttgggaggctgaggcaggaggatcgcttgatcatagctcactttgaggctacagtgagctgtgatcgcgccattgcactccaacctggatgacagagcgagaccctgcctaaaaaaataaaaaaaaaaaggatttttttctgttcagtggattcatttgaagcgagggccactggtatttgaaatagatgacatcatctgccagcagaggcgtgaggcaacttgaggcggggtgtgggcctgacgtcatcacgcagcctcttcctttccccgcccccttctcttggcgaacgaggcgtcagtttaacacctccgtgaatccggaagtatgctgtcaaaacaaccaaaccacggggctgggggaggcggggcctcagtaggcgtctgcacgctagctgaaatagagcaaaatgcccgacttttgggggcggggctcctggcaacagcactctaggcgcaggcgcagaggcgacctccaggcagggccaggtgggagggacggtggggggtagggtcgcgcggcgccctctgcgcctgcgccccggcacgaggtggggcggcgggcgtcagtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaaggtgaggctggcggtgagtcggcccagccgccgaggcatcccaggggagggggaggcggtggctgtcataggatggagggcgggacctgagatttcggacataacctgagcggcgaagcttgagggccaagtgatgatggcgaggggtagggagggcctgagagcctgagagcgttagcgacgtaccttggggcgtgggactgaaaatagagggacgaggcgggggtctatgggatgaatgggtggagcttatagacaaaggggaggggctatggggctggaggaggggccgcagtagttgagggtggggctctgaggaatgagaaggtgctggctctggagtcagtcaacccatgtgttgagagtgcacttatgtgcaagttcccactttgatgagctgacaggctcgtgggtggagacaactaaagaaatgagatgcttcggacactaaaataatgaaaaaggttatgaaatagggagtcacgttagccaaggttgtacagggaaatccccagaggaggtattgaaggagcagagacccgaataaaaggagtcagccatgtgcatattagaagggaagagtattctaggcagaaggaatagcaagggcaaagactagaggatgggaatgagcctggcatgttcccgtaggttcctgattgctggagtggagagaatgaggggaagagtggtaggaggtgaatcagagcgctaagacagagacagatcgccaagggcctttggtgtgtatgctgaggaagaacgctgttgccatagttccagtaaacaatgatggtggctccgaccaaccagtggcactggcagtgataagagggtccacacatcacttcagtgtaatagagctctaaggtagaagtttgacattcagaaaaaagatgatgcctgagctgggcgtgaaccacgtgaagaaagtgggagggatgttccagacaggggatcagcacaatcaatggcctggagtcaggatggtttcaaggtaacttctaacagtttggtactactagagtgtaaagttcaaaaaacctggtgagaggctggctggggccccataggcccgcttgctgggactctagggttgccattgaagagattgaagcaggggagtgttgtaggtagatgtgttagattggttacagcaccatagaggactgatttaacaggagccagactggacacggtgattctggcaaccatagttgaagggatatagaagaaggattgggggcctgaactcttgcagtagcctcctcctcactggaccctgtggtccagaacacctgccttgatctggcccctggcacctctctgactttgccttctaccactctgcacctcactcttcagcatggtgatggggcccctggtggcctaccccatgtcttctctccccagaaatgtgagagcttcttgccgccagagttccgctcttttgctgtagatccccagatcacctcgctcgacgtgttgcagcacatcctcatccgagcctttgatttgagtgggtgagtgggaagatgctggggactggccagtgggccaccgacctctacagtggctatctggcctttgtttggtagggtttttgtttattttactactacaaataatcccacagtgaacagccacgtatgcatgtcttggagcacagtagtctacttttgtctgtggttttgctttctgcagtttcagttacccatggtcaacctcagtctgcaaatattacatacaataagatattttgagagagagagagagaccacattcatattacttttattacagtttacagacagtccccaacttacaataactggacttaggatttttcaactttacaatggtgcaaaagcgatacgcatttggtagaaactgtactgcaagtgcccagcgattctgcttttcactttcagtacagtgttcaataaattacatgaaatattcaacactgttgtaaaacagactctgtgttagatgattttcccaactgtaggctaatgtgagcgttctgagcacgtttaaggtaggctaggctaacctgtgatgtttggtaggataaatgtgttaaatgcattttcctttttatttctttttttttttttttttgagatggagtctaactgtcacccaggctgcagtgcagtgacatctcccaggttcaagtgattctcctgtcacagcctcccaagtagctgggactacaggcatgcaccactatgcccggataattttttttttttttttttttgagacggagttttgctcttgtcccccgggctgcagtgcagtggcgcagtctcagctcactgcaacctccgcttcccgggttcaagtgattctcctgcctcagcctcccaagtagctgggattacaggcacgcaccaccacgcctgctaatttttgtatttttattagagacaaggtttcaccatgttggtcaggctagtctcgaacacctgacctcaagttacctgtccacctcggcctcccaaagtgctaggattacaggtgtaagcccccgcacccagtcccagatagttttttgatcttctcttttttttttttttggagacagagtctcactctgtcacttaggttggagtgcagtggtccgatgttggctcattgcagcctttgcctcccgggttcaagtgattctcatgcctcagcctccagagtagctgggattacaggtgtgcaccaccacactcagctaattttcatgaggttggtcaggctggtctcaaactcctgatctcaagtgatccgcccacctcggcctcccaaagtgttaggattacaggcacgtgagcctccgcacccggccaattttttgtatctttagtagagacagggtttcgccatgttgcccagggcagtctcaaactcctgagctcaagcaatccgcccgcctcagcctctcaaagtgctgggattacaggtgagccactgcgcccagccaaatgcattgtcaacttacagtatttccaacttacgatgagtttattggtacataaccctgtcataagtcaagaagcatctgtattgtcataattgttctattattgttaatctcttactgtgcctaatttatcaattaaaccttatcataggtatgtatgtatatgaaaaaaaacatagtatatatagggcttggtactatctgcagtttcaggcatccactcgggggggtcttggaatgtatcccctgtagataaagagggactactgtatttggaaacatctagtcataggataaattcctagcagtggtattgccaggtaaaagggtatttgctttaaaaaaaattttttttttgagacagtctcattctgtcgtccaggctggagtgcagtggtgtgatctcgtctcattgcaacctccacctcctgagttcaagcaattctcctgcctcggcctcctgagtagctggtactacaggcgtgcgccaccatgcccggctaatttttgtatttttagtagagatggggtttcaccgtgttggccaggatcgtctcgatctcctgacctcgtgatccacccgcctcagcctcccaaagtgctgggattacaggcatgagccaccgcacctggcctgctttttgaactattaatgggtgtttccaaaatgctctccagacaggttttatcaatttatgatctcagccgggcgctgtggctcatgcctgtaatcccagcactttgggaggctgaggcaggtggatcacgaggtcaggagatcaagaccatcctggctaacacggtgaaactccgtctctactaaaaatacaaaaaattctccaggcgtggtggtgggcgcctgtagtcccagctacttgggaggctgaggcaggagaatggcatgggcccgggaggcggagcttgcagcgagccgagatcgcaccattgcactccagactgggcgacagagtgagactccgtctcaaaaaaaaaaaaaaacgaatttatgatctcatcagcagcacataaatgcctgtttccctcacaccctcgcaaacattggttactgtaaaactgcaaaatttgccaatctgatagctgaaaagtggtgtctcttgggggcagatgtgatagtcattttgttgtgattttggaggaatacatacacatggtaagaaattcaaacagtacacaattgttgggtatttaggatgtttccatggttatgatgagcatcacgcaacaaacttctttacatagttgcacaagtatagctgaaaaattcttagttgttattagactttcttacataaacatttttgttgtgaaaaataacaaacacagattgctttttttttatgtagtaagaaggctgctttcttcccacttctgtcccacatctaccccagaggggaccaacttttttttttttttttgagatggagtcttgctctgtcacccaggttggagtgcaatgccacaatcttggctcactgcaacctccacctcccaggttcaagcgattctcctgcctcagcctcctgagtagctgggattacaggcacctgccaccacacccagctaattttttttgtatttttagtacagaaggggtttcaccatgttgaccaggctagtctcaaactcctgacctcaggtgatccacccacctcggcctcccaaagtgcggagattataggcgtgagccactgcacccggccaacattttaccagtttccaatgtgacctccagatacaagcaggtgtgtacctgcttgtatgtgtttgtgtaacaaagtgggtataaatgacctgatctcaggctgcccataatccttggcacagtaccttgcacatagtaggaagttgttttcaacgccttctatattaccctccttgttttggaaactgtccctgaggcctccagggcaccaggggccctgagagctccctcgtatcccctgtccaggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagtgagtactcagtgcccccaggagcactgctctggaacccctttaccccatagggtgatgctacccctcacagtacactccctcatggtgggatgggtagcaaggtatcctagctatagatcctggctcagccactaggccacaatttcttcacttgtaaagagataattgtatcttagaaccattgtgaggccttgtatcttagaaccattgtgaggggaaattcatataaaatgcctggaacagtgcatgactgcataatgaaggctcagaaagtgttatctctaataatgataattatattgtattatactattataacatataaccgagtaatgtatgtaataattagatataatgcagatttataatatagtataacggtatagctttagcattatgtatttcagttataatacctaaatataacaatgcgtattataataatgctagttgtgtttattcattcagtcattctgcacccatattcatttgtttgtattcttgctcactcattcatttgttcccttgacctctcagccactttttctcttctcatctttgttcttccactcttgcctattctggtccctgcgagcacacagataaattaggacgtggtctcaaaatttgattacagaccatacattagataattgtatcagtattaaatttcctgggtgtgtgtcttagtcgttttgtgctactataacagaataccacagactgaggaatttgtaaagaagagaaatttatttctcacagttttggagactgggaagtccaagatcaaggtgctggcaggttgtgtgtctagtgagggctttcttgctgcatcctcacatgacagaagagcagaagagagtgaacccacaccctcaacctctttataagagcccaaatccgctgggcacggtggctcatgcctgtagtcccagcactttgggaggctgaggcaggcggatcacctgaagtcaggagttcgagaccatcctggccaacatggtgaaaccctgtctctactaaaaaaaatacaaaaattagccgggtgtagtggcacatgcctataatcccagctactcgggaggctgaggcatgagaatcgcttgaacccgaaaagcagaggttgcagtgagccaagatcttgccactgcactccagcctgggtgacagagcgagacttcatctcaaaaaaaaaaaaaaaaagaggctgagcacggtggctcacgcctgtaatcccagcagtttaggaggccgaggcgggcagatcacaaggtcaggagatcgagaccaccctggctaacacggtgaaaccctgtctttactaaaaatacaaaaaaatagccgggcgtggtggcgggtgcctgtagtcccagctactcgggaggctgaggcaggagaatggcatgaacccgggaggcggagcttgcagtgagccaagatcgcaccactgcactccagcctgggcaacagagcaagactccatctcaaaaaataaataaaataaaaaataaaaaaagagccctaatcccatctgtgagagctctaccctcaggacttaatcacctcttaaaggcccccacctcttaatatgatcacattggtaattaaattgcaacacatgaatttggaaggacacattcaaaccatagcagtgtggtagtggtatcatatctattgaaggaaaatatccttgttcttgggaaagacacagttaagtatgaaggggtaaaatgtcatgatgtctgcaaataagttggcaaaaataatgtgtttatatacagagagagtgagataaagcaaatgtggcccaaaaaaatgttaatagaggatctagatgaagtatgtatgggtgttcagtgtattcttttaactttattgtaggttcaaaattgttttaaatagttgtggagtggaagatgtggttcccagcctcaggaaactcatgtgcccatttgggatgagtcgagcactttattgatgtcataataacatataactagctaatgtgtagtgaacacttagggccattctgtgcacataatattttttcactgaattgtcaaaataatcctatagagtagggacaatcattttccccatattatagatgaggaaactgaggctcagagaggtgacaggactcgtcccagttatacagacagtaagttgaagagcaagatttgaactcaggcagtggctgaactggctccagagtccttgttcttaaccatttaactctacaacattttggacttgttaaaattggcagctttgcaaaagagagacagaggagagagagaaacaagagtcagagggaaagatagtgacagagatgggcaggaagccaaataggaaaagccaggtagccagacacacaggaacctctgccactgagtagccatatgtgcttatgtcagtcacttaattccctgggccttgttttcctcacctgttaaagagacacagtagcactatttcaggaaaaaaatcaaatctgcatggctacgaaacatgtggagaaaaccccaagtgcatgagaactgggacgaatgccagtaaagcagagagacagacagaaagacacccagtagtctggcaggaatacatctttaaaaggttatctttttaggccaggcgccgtggctcacgcctgtaatcccagcactttgggaggccgaggcgggtggatcacctgaggtcaggagttcgagaccagcctggccaaacatggcgaaaccctgtctctactaaaaatacagaaattagccgggcgtggtggtaggcgcctgtaatcccagctactcgggagactgaggcaggagaattgcttgagcctgggaggcggaggttgcaatgatccgagctcgtgccaccgcactccagcctgagtgacagaactagactccatctcaaaaaaaaaaaaaaaaaagccctctgtcttatttaccaaattcctgcacaacatcggtctgtttctgaattcctgattctcttacgttgatctatttattaaattataagccaattctatgttgttttaatcattgtagtagtttgttttctgtttgtttgtttggttttgagggttttttttttgttttttttttgagacagggtctcactctgtcatccttgctggagtgcagtggcccaatctcagctcactgcagcctccacctcccaggctcaagcaattgtcccacgtcagcctcctgagtagctgggcctataggcacatgcccccatgcccagctaatttttgtattttttgtagagacagggtttcgccgtgttgcccaggctggtcttgaactcctggactcaagcagtctgcccgcctcagcctcccaaagtgctgggattacaagcaagagccaccgcacccagccttaatcattatagttttatgatatgttttcatgttttcctttttaaaaaattttcttgaatattcttgttcacttactgttctttttatttaataaatcagcttattattccattaaaatcctgacgggaatttgattggagtcatatttttaagagaaactaatctttcattacccagtaaatacattcttattaaaaataaaagcattttaaataatgctgaagtctcctgggaacgctatgcctaatctcaatcccctaccctaccctttttgccccgagggaatcggtttgatgtgtaactttgcatgtcctttacttatttacactccctacacacacatttatccacatatgtgagtatattcatatttgcgtgtctgtacacataaacggtatgtgtttaacataaggtattctacacattaatatgtaagtgtccaatatatggagctatcattagacatattaatggcattctcatgatcattttcatggctgtgaaagcaacagacatgttgggactgtttggatggcccagtccctctttctgggaaaaagccagtttctgtcacctctacagttgggagattacaaagcctagacctttgaccaatttgtacttttccgatatgaatcttttttctttttgagactctctttgtcaccaaggctggaatgcagtgacgcaaatatggcccactgcagccttgacctcaagctctcctcctgcctcaggctttcaagtagctgggactacaggtgtgcaccaccatgcccagctaatttttgtattttttgtagagacatggttttgccatgttggccaggctggtctcgaacttctgacctcaagtgatccacccacctcggcctctcaaagtgtttggattacaggcgggagccaccgtgcccagcccccaacctcctttctatcataggtactgcaaatatttttcccagttgatcttttgttttttggctttgcttacgggatggatctgttttgtcctatcaaaattaaacatttgattgcacgcctacacagatatctatctttttctttatgatttctgagtttctcctttttattgcaggtggagggacagagtttcactctcattgcccaggctggagtgcgatggcgcgatctcggctcactgcaacctccgcctcctgggttcaagtgattctcctgcctcagcctcccaagtagctgggattacaggcatgtgccactacacctggctacttttgtatttttagtagagatggagtttcaccatgttggtcaggctggtatcgaattcctgatctcaagtgatccacctgcctgggcctcccaaagtggtgggattacaggcatgagccactgtgcctggctgagtttctcctattactttggaacatgttccccatccataagcttatacaaatattctatattttcttctactatgcttattgttttcttttttacatataaatcttttctctgtcagcattgtgataagcagacctagctttaaaaaaatcaagatagtcaattatgccagcatcattttttttaatttaatttttttttttgagacgaagttttactcttatcgcccaggcaggagtgcagttgcacaatctcagctcactgcagccgccgtctcctgggttcaagcaattctcctgactcagcctcccaaatagctgggattacaggtgcccgccaccatgcctagctaatttttgtatttttagtagagatgaggttttgccatgttggccaggttggtgtcgaacttatgacctcaggtgatccacccacttcagcctcccaaagtgctgagattacaggcatgagccactgcgcccggcctgccagcatcatttattaaataatcaccttttctgcagtgattcgaaatgccacgtttgtcacatattcagtttccatatatacaagcttggatttatttctgggctttctattgcattctaccaatgggctctatttgtctactgctgtgctaacaccatgttatttttatgacagtggttttgtggtcaaatttttttttttttttgagatggagtctcgctctgtcgcccaggctggagtgcagtggcgcaatctcaactcactgcaagctccgcctcccgggttcacgccattctcctgcctcagcctccctagtagctgggactacaggcgataagcttttgccatcctcccactgttctttgtcttaactttttttttttttttggagatggagtcttgctctgtcgcccaggctggagtgcagtggcacaatcttggctcactgcaagctccacctcctgggttcacgccattctcctgcctcagtctcccaagtagctgggaccacaggcgctcgccaccacgcccggctaatgttttgtatttttagtagaggcagggtttcaccgtgttagctaggatgatctcgatctcctgacctcgtgatccacccacctcggcctcccaaagtgctgagattacaggcatgagccaccgcgcccagcctgtcttagctattcttaaatgtgaattcttctatagaaaccttaagataattttatccggttccaggaaaaacccccattcaatttctgactggcattgcactgagtttatatattaatttagggtttgggaagtttgacaattttatgataaggaaatgcgcgtatcatgaatattatgtaataccacaagcagggtctgggccagcagccaagcagcccacaatgaaacacttggatgtttcttcagggaaatgtgtgcatattcacactacgtgggttatataaagactatatatagtctcctgtcagttcagatcaggttttgctactaggtgagtttgtgtttgtagacattctttgcctgttttttgtttgtttgtttgtttgtttttttgagacactctgttgccaggctggagtgcagtggcacaattccggctcactgcaacctctgcctcccaggttcaagcgattctcctgcctcagcctcttgagtagctgagattacaggcacgcgccaccacgcccagctaatttttgtatttttagtagagacggggtttcaccatgttggccaggacggtctcgatctcttgaccttgtgatccgcccgccttgcttctcaaagtgctgggattacaggtgtgagccactgcgcccggccttttttttcctttttttgagagggagtctcacattgttgcccaggctggagtgcagtggcgcgatctcagctcactgtaacccctgcctcccaggttcaagcgattctccttacctcagcctcccaagcagctgggattacaggcacctgccaccacacctggctaatttttttttgtattttttagtagagatggggtttcaccatgttggccaggctggtctcaaccttgtgatccgcccacctcagcctcccaaagtgctgggattacagacgtgagccaccgcgcctggcctctgcctgttttattagtgggattgagggggtggtttttttaatcagtataaaatgtctctttgtgttaaatgcttttggccttgagtgatgctttttctgacattctcatggctactatttttttctgtttgtgtttaccagatatacctttaggattctttaatttttaacctttttgtgtcacctagttttaggtatgtctctcatacctctcgtaaaaacgtcatagcagaatttatgctttttaaggcaactgacagtgaaatcttttttttttctttttgacacgtagtctcgctctgtcgcccagactggagtgcagtggcacgatctcagctcgctgcaacctctgcatcctgggttcaagcaattctcctccctcagcctcccgagtagctgggattacaggcacacaccatcatgcccggctaatttttttttttttttttttgagatggagtttcgctctgtcgcccagactggagtgcagtggcacaatcttggctcgctgcaacctctgcatcctgggttcaagcaattctccctcagcctcccgagtagctgggattacaggcgctcaccatcacacctggctaattttttgtatttttagtagagacggggtttcaccgtgttagccaggatggtctcgatctcctgacctcatgatctgcctgcctcggcctcccaaagtgctgggattatagtcgtgagtcactgcaccccgccccaacagtgaaatctttaggccactttttctcctttaatctctcccactttttctggcctttaaaatggagctttggaacacttgtaattcttattcgttttctggtccctaacccttaacttctagcttttgcttagacaacttttttttttttttgagatggagtcttgctctgttgcccaggctggagtgctatggcacaatctcagcttaccgcaacctcctcttcccaggttcaagcaattctcctgcctcagcctcttgagtagctggggtaacagaagcgcaccaccacacccggctagtttttttatatttggtagagatggggtttcaccatgttggccaggctggtcttgaactcctgacctcaagtgatttgcctgcctcggcttcccaaagtgctgggattacaggcatgagccaccacacccagccaattttttttctttttaaattccgggttatcattctgttttcttactaacacactaagtcacttatgtttcaggaatcctaatgtaacatataatattacaaacccccaatcatgttatcgttgtcattttaactataaatattaaatatgtaatatatataatataatatataatatataaatattaccatttaccttcccctttgtctctccctatcttaagcccttctagtcatgcaggagtcatttgctcagagaacttctttgttctcctccaaaagtgcatgggttagatgtactctaatggccaaaaatgtttttatttggctgaatagatctgtactgtcttggctgggtgtggggcccttggatctcaggtctttcttcttagtgctccataggtgctgtgagctactgtcttattgcctccagggttgtgaagcagaagtctgttgcttgtctgaccttctttccattgtaagcagccgttttttgtctctggaagctgcaagagtttttctttttcttttttttttttttttttttttgaggcaggatctctatttcccaggcgggagtgcagtgacgtgatctcagctcactgcaacctctgcttcccaggttcaagcgatcctcccacccacctcagcctcccgagtggcagggactacaggtgtgcgccaccatgcccagctaatttttatatttttgggtagagacagggttttatcatgttcagcccaggctggttttgaactctcgggctcaagcaatccgcccgccttggcctcccaaagtgctgggattaggctgggcatggtggctcatgcctgtaatcccagcactttgggagaccgaggtaggcggatcacttgaactcaggagttcgagaccagcctggccaacatggtgaaaccccgtctctactaaaaatacaaaaatttgccaggtgttgtggcgcacacctgtagtcctagctacttgggaggctgagacaggagaatcgcttgaacccgggaggcggaggttgcagtgagccaagatcacgccactgcgctccagcctgggcaacagagcaagactctgcctcaaaaaaaaaaaattgctgggattacaggcatgagccattgcgcccagtctaagagtttttctttattcttagaatttgggcatttcgggctgggcgcagtggctcacgcctgtaatcccagcactttgggaagctgaggcaggcggatcacttgaactcaggagttcaagaccagcctggccaatgtggcaaaaccctgtctttactaaaaatacaaaaattagcaaaaattagccgggcgtggtggtatgcccctggaatcccagctacttgggaggctgaggcaggagaatggcttgaacccaggaggcggaggttgcagtgagccgagatcataccattgtgctccagtctgggtgacagagcaagactccatctcaaaaaaaaaaaaaaaaaaaggatagggttggtggggggcctgttgtgtgttgttagttaattaatcctatctaagacttggtgagccattccttcatctcagggaaattttctttcatacttgtttaattctgacatctccacctgatcccttttctccccctgcatttcctattatttccatatttggtctcctggacttggcatccaggtctctctactttttcactcaaatcattgaaccttagctccatgccttgcagtggttcttctgttcagactttcagaccattactgatttttcataatgtgaccttcttcattttacctgttaagtgttttaatgctctgattaatgttttagaaagaccattctggcagctgttgggagagattggagaggaatacagaggaagtgaggactggttaggaggcagtttcaggtgagagatatggtggctcagacagggtgagaagatggagatgagagaacaggtaggatggaggaatgctttacatgcagtagccgtaggacttggcggtggtttggacctgggagttaagagagtgggagggggacaaggatgtctctcaggtttctggtctattaaacaactgaacagatagagatgctgtttgttgagatgaggagtagaggaggaggccatgtctagagtggatcttgggctcctctctttggaccccttaggtttgcagtaccccatgagacatccagggaaaagcagtgacatgcaaacatggcctagggtttgttccccccctcagctctatgggaaaattgggctccatgggaatgctgtttagggatggcatttgcttgcaaatgacagtggcttaaacagatagaagttgattggtttcacacaaaagagtttgaaagttagccacttgggccggatgcagtggctcacgcctgtaatcccagcactttgggaggccaaggtgaagggggcctgcccctccacacttgtgggtatttctcgttaggtggagacgagagattgagaaaagaaataagacacagagacaaagtatagagaaagaacagtgggcccagggtaccggcacactcagcatgcgaggacctgcaccagcgccggtctctgagttccctcagtatttattgatcactatttttactatcttggcaaggggagtgtggcagggcaacagagtgttggtggggagaaggtcagtagggaaacatgtgagcaaaggaatctgtatcatgaataagttcaaggaaaggtactgtgcctggatgtgcatgtaggctagatttatgtttcactttacacaaatatctcagtgtagcaaagagtaacagagcagtattgctgccagcatatctcgcctccagccacggggcaattttctcctatctcagaatagaacgaatggtcggctttacaccgagacattccattcccagggacaagcaggagacagaagccttcctcttatctcaactgcaaagaggactccctctttcactactcctcctcagcatagaccctttatgcgtgtcgggctgggggatgtaaggtctttcctttcccacgaggccatatatcaggctgtctcagtgaggggaaactttggacaatacccaggctttcttgggcagagttccctgtggctttccacagtgcattttgtccctggttaatagagaatggagaatggcgatgacttttaccaagcatactgcctgcaaacatattgttaacaaggcacatcctgcatagccctaaatccattaaaccttgattcaatacagcacgtttctgtgagcacatggttggggctaaagttacatacagattaacagcatctcaaaccagaacaatttttcttagtacagatcaaaatggagtttcttacatcttccttttctgcatagacacagtaacaatctgatctctctttcttttccccacataaggcgggtggatcacctgaggtcaggagttggagaccagcctggcaaaccccatctctactaaaaatacaaaaaattagccaggcgtggtggcaggcacctgtaatcccagctactcgggaggctgtggcaggagaattggttgaacctgggaggcagaggttgcagtgagcgaggatcacaccattgcacgccagtgtgggtgacagaacaagactccgtctcaaaaaaaaaaaaaaaaaaaaaagccagccactggacattgccattgttggcttagtagccctctcgtatcagggctgtaggagaggatctctgaagatcctctcgaacctactctcagatggccactgctgcttcaaccaccacatcttatgtgaggtgggaagaaagaatgcggggcaaaatgaaaaagaaagagaaacggtcaggtgcagtggctcacacctgtaatcccaacactttgggaggccaaggcaggaggatctcttgagcccaggagttcaagaccataggcaatatagtaagatcccatctctaccaaaaaaaaaaaaaatcatccacgcatggtggcacacgcctgtaagccccagctactcaggaggttgaggcaagaggatcgtttgagcccaggagtttgaggctgcagtgagctatgatcgcaccactgcactccagccttgggggacagagcaagactgtctcaaaaaaagaaaaaaaagatgcctgtaatcctagcactttgggaggccaaggcgggctgatcacctgaggtcaggagttcgagaccggcctgggcaacatagcgaaacctcatctctactaaaaatacaaaaattaggccaggtgtggtggctcatgcctgtaatcccagtaccttgggaggccgaggcaggtggatcacctgaggtcgggagttcgagaccagcctgaccaacatggagacaccccgtctctactaaaaatataaaattcaccaggcatggtggtacatgcttgtactcccagctactcgggaggctgaggcaggagaatcacttgaacccaggaggtggatgttgcagtgagccgagatcccgtcattgtactccagcctgggcaacaagagtgaaactccgcctcaaaaaaaaaaaaaaaattagctggacctggtggcaggcacctgtaatcccagctacttgggaggcttaggcaggagaactgcttgaacccaaaaggtggagtttgtagtgagccaagattgcaccactgcactccagcctgggcgacagagtgagactccatctcaaaaaaaaaagaaaaaagaggctgggtgcagtggctcacgcctataatcccagcactttgggtaggccaaggcgagtggatcacgtgaggtcaggagttcaagaccagcctgaccaacatggtgaaactccgtctctactaaaaatacaaaaattagctgggcatggtggcaggcacctgtaatcccagctactcgggaggctgaggcaggagaatcacttgaaaccaggaggcagagtttgcagtgagctacgttcacaccactgcattccaccctcggttacagagtgagactccgtctccaaaaaaaaaaaaaaaaaagcatatacggcatacctgttccacttttgcacaaatattttatttctaaagtatgtctgggctctggactagggtgaatgaagttcagatcccagccctactatttcctggctgtagaatcttggtcacttactatttgttccaaacctttttgtcatcgtctgtaaaatgagaatggtaatattagcgtgcactgtttgtgggaggaggactggcaaaaatatgagagtaggagtttgggctcttgagcttgggcctggccttcaaatttccactctttcactcactagctaaggggccttgggcaagtaccttatcatgactgtgcctgtttcctcaaagagagtcatggtagtagtagtactcaaccgataggactgaagtgactattgcatgagtcagtattggcaaagaattcagaatagttcctggcatacagcactgtggaagcattagctagtattattatttcttatattgctgttgagcgcttgtcctagtgcttggcacatagtaactgctcaataaatattactttatatcattaaaatattagaggctgcccagccagttcctgagacatctactacaaaagaattgttcatggtttgattttgttttttacatgatttggatgatacaggaagagggactgggagttgtttgttcccctgcaggtagcccggcttcagtagaaggagaggaagccggccctgaggtctgggttatcatccccattcttatagcactttgttctgtttgcccaggcccattgctagaagactgggacataatcagccccaaagatgtcattggctccgacgtgttgctggctgagaaacggtcatcactgacgactgccgccctgccctttacacagtccatcctcactcaggtgttttcagggaccctagggacccagctgtggttggagggcagagccttcctggcaccctggttctgagcatgctggttggcatctgcccctagtccacacagctgatggtggcctccctccctcctcataggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtgagcatcctcagtcatctgttgggtccatcactgctgcactcattaacagctcctgagacacatgcagtcagccacactgctgtgggcaagggtggagatgttacagggcacgaagttctctttaaggaggggcgagcagtcggaggcctagcagacttagaaggaagacagaggcccaaggggggtgggtgggtggcaactgatagacattggggtatggtttatctggagaactccagcctcatccctttcacccctgggcaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctctgggatgcattctgtgatttatgagctcaggtgtttgaaggaccagacaagccaattctgtggatagtagtttgggacctctgagagatagaagagtcctttctgtgaataggaggctcagataccctgaaaggcagaaacctctaatattcctctaggatacttggggtttctggttcctgcaaagatggcagacagcacaagctactgattcctttgcccgaaaccaactctggagaaactagagagggaaacatgggttccagaaattgcaacatagcaatgagagacccatggggaaatggaaggctgtctttaactggtgtgtgttttgacgggcggatggccagaggcagtaaatagaggataggttagggaaaaagatatttaagttctggctctcacctctcccctatattgccttggggaggtccttgtttgcccccttcattgcattaatcatccaaaccactggtacacatgtctgggggactaggatcagggcagcaagggccctgcaggggaaagaaataggcagccagaggaaatcagtcctccacctgtctccctccagacacccgggctggtggattacacctaaggagactgccacctctttttttttttttttttgagacagagtcttgctccatcacccaggctggagtgcagtggcgcgatctcagctcactgcaacctccgcctcccgggttcaaggaattctcctgtctcagcctcctgagtagctgggactacaggtgcctgccaccatgcctggttaattttgtattttagtagagacggggtttcaccttgttggtcaggctggtctcaaactcccgacctcaggtgatccacccgcctcggcctcccaaagtgctggaattacaggcgtgagccaccgcacccagccaaaactggcacctcttaaagcggttttcctccgacggtttaaagatgaaccccacgctagggggattgtcaggtgtccaaagggcaggtgagcgggataactgtgcttctgtggtacctgtggctgtccagcctctggctcctctcccacacatccttttacccctggagctccaggtcattaagctgactcgagtcaggccttcagcctttcctcagtacgttctatcagccaggagagcggataatttcaggggcatgtaagttcaccaccaaaataaccagacaccagggcagtatgacttccaccaaagaaaaaataaactggacattctctagtgctggataacaaattaccccaaacttagccacttaaaacatcacagtttctgagctgggtgtggtggctcacacctgtaatcccagcactttgagaggcaaggcgggcagatcacctgaggtcaggtgtttgagaccagcctggccaacatggtgaaaccacgtctctactaaaaatacaaaaaattagctgggcatggtggcacacctgtagtcccagctacttgggaggctgaggcaagagaatcggttgagcccgggaggcggaggttgcagtgagccaagattgtgaccctgcactctagcctgggtgacagagtgagactctgcctccaaaaaaaaaaaaaaaacaataaaaaccatcacagtttctgagggtcaggaatctggaagcagcctagctgggtagttttgactcatggtctctcctgacgttttactcaagttggcagccaggactgcagtcagatgacagcttcacttggctgacagacccacttccaacatggcccactcatcgggcagttggcaaaaggcttcaatttctcaccacctgagcatctccgtggggctcctcacaacatgtcatcctaacgagcaggtgagaccgtgaccaagacggaagccacaatgtctaccttaacctcagaaaagacagaccatcatttctgctgtgttactggtcacatagaccaaccctagcacaacatgggaggggactatacagggcatgaataccaggaggcaggaatcatggggggctatattggaggccgcctcctacactgggtaacatataatatctgaagcagaagtattgagacagatgaaaaattttaaataaacataataaataaaaactattagaatatagggctgggcgtggtggctcacgcctgtaatcccaacactttgggaggccgaggtgggcagatcacaaggtcaggagatgacaccatcctggctaacatggggaaaccccgtatctactgaaaatagaaaaaattagccaggtgtggtggcacacgcctgtagtcccagctacttgggaggccgaggcaggacagtcgcttgcttgaacttgggaggcggaggttgcagtgagccgagataacgccactacactccagcctgggcgacacagcgagacgccatctcaaaaaaaaaattagaatacaaaacaggaactagagattataaaaaggacccccaaaaatgttaggtgtgagtatgatggtagagaaaaacaaaacagcccagcgtggtggctcacgcatgtaatcccagcactttgggaggccgaggcaggaacatcacttgagctcaagagtttaccagcctgggcaacgtggcaaaatcccatctctacataaaatacatctctacataaaatacgggtgtggtggtgtacccctatggccctggctacttgggaggctgaggtgggagaatcacttgagcccaggaggttgaagctgcagtgagctgagatcgtgccattgcactccagcctggatgacaaaagcaagaacctgtctcaaaaaaataataatacaaataaaaaaactgtaaatggagaatatggaatgagatgtcccagtagtaattacaaaaatatttgaaacacagagaccctcattggattaaaaaaaaaagtccaatagcatacacacacacaaagatttagaaatgttgaaaatgaaaggatggccgggcgcagtggctcacgcctgtaatcccaacactttgggaggctgaggcgggcggatcatgaggtcaggagatcaggagatcgagaccatcctggctaacatggtgaaaccctgtctctactaaaaacacaaaaaattagccgggcatggtggcaggcgcctgtagtcccaggtactcgggaagctgaggcaggagaatggcgtgaacccgggaggcggagcttgcagtgagccgagatcgcaccactgcaccactgcgctccagcctgggcgacagagcgagactccgtttcaaaaaaaaaaagagaaaaaaaattagccgggcgtggtggcggacgcctctagttccactgtagtcccagctgctcaggaggctgaggcaggagaatggcgtgaacccgggaggcagagcttgcagtaagccgagatcaggccactgcactccagcctgggtgacagagcaagactctgtctcaaaaaaaaaaaaacaaaaaacgaaaagatgaagaaaggatatggcacattaaaagcccaaagaaagctaagatagctatcctaatagctaagaaaataggtcgggtgcagtggctcttgcctataatcccagcactttgggaggccgagacggacagatcacttgaggcaaggagttcaagaccagcctggccaacatggtgcaaccccgtctctactaaaaatacaaaaattagcctagaatggtggcatatgcctataatcccagctacttaggaggctgaggcaggagaatcgcctgaacccaggaggcggaggttgcagtgagctgagattatgccactgcattccagcctgggtgacagatggagactctcaaaaagaaaaaagttggtaaaagagcagaggaacaaacccaaaggattgagtcatggaggaaataatacgaggaaggaaaaagatacaatagagaattgtaaagtaataataaagattaacagaataggccaggtgcggtggctcacacctgtaattccagcactttgggaggctaaggcaggcctatcacttgaggccaggagttcaagaccagcctggccaacatatgaaaccccatctctactaaaaatacaaaaattagctaggcatggtggtgcatgcctgtagtcccagctactcaggaggctgaggcaggagaattgcttgaacctgggaggcggaccggaggttgcagtgagccaagattgtgccactgcacaccagcctgggtgacagagtaagactccatctcaaaaaaaaaaaaaaaaaaaaacaccaggcacagtggctcaggcctgtaatcccagtgctttcagaggccgaggcaggtggatcacttgaaggtcaggagtttgagaccagcctggccaacatggtgaaaccccgtctctactaaaaatacaaaaaaaaattaggtgggcgtggtggctcacgcctgtaatccctgcactttgggaggccaaggtggacagatcacctgaggtcaggagtttgagaccagactgaccaatatggagaaacctcgtctcctaaaaatacaaaattagccgggtgtggtggcgcatacctgtaatcccatctactcgggaggctgaggcaggagaatcatttgaacctgggaggcagaggttgtagtgggctgagattgcactccagcctgggtgacaaagcgagacttctcaaaaaaaaaaaaaaaagctggtactttgaaaataattaataatgatagacctttgccaagactgatttaaaacaatgcaatgcaaaatgcataacaaaggaaaattatagatacaaaaaggctacaaattgtaagctaatacacttgaaaacatagatgaaaaacaaaaatttcaggaaacattaaaatgtgttcaaatgaatgcaaaaagaaatagaaagcttgaatataacttgaatatacaataaattttaggaaaaattaaaatgataatcaaagataccccatcttattgtaataaacagcctcaggcccagccccagacggttttgcagattatagttctattaaactttcaaggaactgtaattcccatcttatacaaattgttccagaagataggaaaagagaaaaagccatacacctcattttatgaggctaaaatagttttgattctaaaaccagataaggaaaatactaaacagtaaatttatagacccactggacttatgaatatagatgcaaaaattctaataaaatattagctacctgaattcaatagtgcgttttgttttaaatcataagtagggtttatcccaggaatacaattgatccaaattagaaaattagtgaatgcaggccgggtgtggtggctcgcacttgtaatcccagtactttcggaggctgaggcaggcggattacgaggtctggagttcgagaccaacctggccaacacagtgaaaccccgtctctactaaaaatacaaaaatcagctgggcgtggtggcaggcgtctgtaatcccagctactcaggaggctgaggcaggagaatcgcttgaacctgggaggcggaggttgcagtgagccgagatcatgccactgcactccagcctaggtgtcagaggtagactccgtctaaaaaaaaaaaaaagaaaagaaaattagtgaatgcaatttaccatattaataaaggaagaaattatatgataatctcaaagcagaaaaggatttgataaggttcagtgcctgtttatgatatttaaaagggggctgggcatggtggctcgtgcctgtaatcctcatactttaggaagctgaggcaggtggatcacttgagcccaggagtttgagaccagcctgggcaacatggcaaaaccccatcactacaagaaaaaaaaaaaagaactctttgcaaacaaaagtagaagaaaacttctttaacttcatacatagcaaaatattacagcaaaaaatgcttaatagggaatttttttttttttgagacggaatctcactcttgttgcccaggctggagtgcgatggcacaatcatggctcactgcaacctccgcctcccgggttcaagcaattctcttgcttcagcctctcaagtagctgggattaacaggcgcccaccaccacacccagctaattttcgtatttttagtagagacagcatttcaccatgttggccaggctggtctcaaactcctgacctcaggtgatccactggcctcagcctcccaaagtgctgggattacaggcatgagccaccaaacctggccaatagagaatttttaaatgcatttccctttaagatcagggacaaggcaaggatgttcactcaatactactctttaatataaaaccacctaatgctatgaggaaaaataaatgaggtatacattgtagaaggaattgataaaactcatttgcaaattatatgagtgactaccttaaagaaccaacagagtcgggcgcggtggctcacgcctgtaatcccagcattttgggaggccgaggcgggcggatcacgaggtcaggagatggagaccatcctggctaacacggtgaaaccccatctctactaaaagcacaaaaaattagccaagtgtggtggcgggcacctgtagtcccagctactcaggaggctaaggcaggagaatggtgtgaacccgggaggtggagcttgcggtgagccaagattgtgccactgcactccagcctgggtgacagagcgagactccatctcaaaaaaaaaaaaaaaaagaacaaacagaatgacaaaaacaactaataggactaataagagagttcagcagccaggcgtggtggctcacacctgtaatccctgcactttgggaggctgaggcggatggatcacctgaggtcaggagttcgagatcagcatggccaacatgaggaaaccccatctctactaaaaatacaaaaaattagctgggcgtggtggcacgtgcctgtaatcccagctactcaggaggctgaggcaggagaatcacttggaacccgggaggtggagtttgcagtgagccgagatcgcaccactgcactccagccttggcaacaatagtaaaactccatcttaaaaaaaaaaaaaggggttcagcaaggtttcccaatacaaaatcaacatcaacctgtaaaaatcaaaagcatttctgtatagcagcaataaccaacaaaaaaaaaaagtaggaatgaatttaatacaagagacctctattttaaagaatttaaactctaacaatagaaattgatctgaataaaagagagacattttatgctctttgctggaaagattttggtaatatataagttatttttaacaaattatcccaaaacttagtggctaaaacaatacacatttattatttcacatggttttggagagtcaggattctgagagtggcttaactgggtggttctgactcagagcctctcatgaggctacaatcaggatgttggccaggactgcagttatctgaaggctgggatccacctttaagaaggcttgctcacatggctgttggcaagaggccttactttcttgccacctagatccctccatagggctgctcatgacataccagctaatgtcccacataatgagcagtctgtgtgacagagagcatgaagcagatgtgccttttacagcctggtcttggaaatgacacactatcacttccacctcattctgtgctttacaattgagtcactaagtccagcacacatgcaagtggaaggaagttaggctccaactcttgacgagtacagtatcagagtgtgaccatatcttaaaacctccacagttaatattattaagatgttattttggccgggcatggtggctcacacctgtaatcccagcactttgggaggccgaggtgggtggatcacctgaggtcaggagtttgagaccagcctgaccaacatagacaaaccccgtctctgctaaaaatacaaaattagccgagcataatggtgggtgcctgtagttccagctacccaggaggctgaagcaggagaattgcttgaacccgggaggcggaggttgcagtgagccgagattgcaccattttactccagcctgggcaacaagagcgaaactccatctcaaaaaaaaagacgttatttctcccaaaatgtaaaaattcaatgcactctcaataacacttccattacttttttttttaatgttttgaaacagggtctcactttgttgcccaggctggagtgcagtggcacgatcatagctcactgcagactccaactcctgggttcaagcgatcctcctgcctcagcctcccaggtagctgggatttgggcgagagccaccatgcctgacctcattacttctttttgttagaactgcaatacacttacattagaatttagaatagtaatgaatcatggacagttaagacagccttcaaagaaagcgttatgatggggatttgcccactagatattaagacatattaaaggtgttagtaataaaagggaaaaaaaaaacaacaacaaacctatattggcccaagagctaagaagtagaccaattagaagagaaggccgggcacggtggctcacacctgtaataccagcacttttggaggccgaggtgggcagatcacaaggtcaggagatccagaccacggtgaaaccccgcctctactaaaaaatacaaaaaaaaaaaattggctgggtgcggtagcaggcgcctgtagtcccagctactcgggaggctgaggcgtgaacctggaaggcagagcttacagtgagccgagatcgcgccactgcactccagcctgagcgacagagcgagactccgtctcaaaaaaaaagaccatcctggccaacatggtgaaaccccatctctactaaaaatacaaaaattagctgggcgtggttgcacgcgcctgtagtcccagctactcaggaggctgaggcaggaaaatcacttgaacccaggaggcggaggttgcagtgagccaagatcgcgccactgcactccagcctggcgacagagtgagactctgtcaaaaaaaaaaaaaaagctcagaagtcaggtacaatagtgctcccctgtaatcccagttactcaggaggctgagttggggagaatgcttgaggccaggagtcagcctgggctcatctcttaaaaacaacaataacaacaaaaccagcaacaaaccacctcagagacagacccatatatctatggaacttgatacatgatagaggtggtaaaacacacacagggatgggacagattgcttaatagatggtgatggggcatctggctcatgacacagagaaaaataaaattggagctctatctcacaccatatacaaggacgaactctacatggattaaagacctaaatgtggccgggtgcggtggctcatgcctgtaatcccagcactttgggaggccgaggcaggcgaatcacttgaggccaggagttcaagaccagcctggccaacatggcaaaaacctgtctctactaaaaatgcaaaaattagccaggtgtggtggcacacacctgtaatcctagctacgcagcaggctgaggcaggagaattgcttgaacccaggaggcggaggttgcagtgagccgagatagtgccattgcactccagcctgggcaacaagagcgaaactctgtcaaaaaaaaaaaaaaagaaagaaagaaagaaactgtaggggaacattttgtgacctgggaaagagaatgatttctttaaaagcacagaccaggccgggcgtggtggctcacgcctgtaatcccagcactttgggaggccgaggcaggcggatcatgaagtcaggagtttgagaacagcctgaacaacatggtgaaacctcatctctactaaaaatacaaaaattagctgggcatagtggcacatgcccgtaatcccagctactcaggagactaaagcaggagaatcacttgaacctgggaggcggaggttgcagtgagctgagatcatgccactgcactccagcctgagcgacagagtgagactccgtctcagaaaaaagcacagaacatagggggaaaaatgattatatcaaaattatggatctttattcaactaagtttactgcttacaaagttaataacacaaatgccagagctggagaggctatttccaacacctaagggattaataattagactatgtgaggaatccctgacaataacaggaagataaatatgggaattaccccaacaggaatatggatgtactgtattctgtatgttagcaaatttggtctgtgttgggcaaattcattctatggataagaaatttagcctctgagggcaaactaacttattcttcgttgatgtggcgctcagaagtgaaaaatctgtcaaatccatttattgtaaaggtggccaagacactgaagactaaattgtgaacagtgggctcagacactacttgattgggataagtctattgtgtattgcgaaagtcccttctgtgaatcaagggctcagttactttttttttttttttgagactgagtcttgctctgtcgcccaagctggagtgcagtggcatgatctcagctcactgcaacctccacctcccgggttcaagcgattatcccgcctcagcctcctgagtagctgggactacaggtgcctaccaccacgcccggctaatttttttttttttttgtattgttagtagagacagggtttcaccatattggccagggtagtcttgaactcctgaccttgtgatctgcccacttcggcctcccaaagtgctgggattacaggcatgagccactgcgcccggcaagggctcagttactttcgaagagagcaaaaattgctctatggattgggatttacaacctctgaagatcgtagcatcctcttttgttttgttttgttttcacccaggctggagtgcaatggcgtggtctcggctcactgcaacctccgcctcccgggttcaagcgattttccagcctcagcctcccgagtaggtgggactacaggcacgtgccaccacacccagctaattttttttttctttttttttttttttttttttttttgtatttttagtagagatggggtttcaccatgttggccatgcaggtctcgaactcctgaactcgtgaaccgcccgctttggcctcccaaagtgctgggaatacaggcgtgagccaccgcgcccggccagcatcctgttttgtaaaagccatctcaggcagtctattggtgagaaaattaaggggctggcttcacgccagcagtcagacaagggtgagggctgaagtcagagatgagatggaatgacgccagggaaaagggtcccatgacaggcggctagatgttgagcacagaggagaaagagtaggagtcagggtcaaaccttaaaacgttgggtctgacatcatggactgtgaagggtgatgacatcagtgacggtgggggataaaatgtcaggcctttaaagggtatgaggttaaagaactagaaggtgaaggaggttaacatcagagaatggcagggacctagaggaagacgactacgatggtgaggaagacatccgatccagcgggggaaatgatggcaaggacgggaggatgatgtcagggacagcaagtagtatgagattgagaaggttcctttgtggaagggataaaggcagctcagccggttgtgggggggatgctgacgtttagggtgcaccagctgttcaaaagtcgaccccatttccggaaacaccccatttccggaaacaccccatttcgcggagaacactgctcccttcgctttgctgtcccttcctctccccaccactccgctcctgctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggtaagttgcatatgtcctgcgaaacggcggctcctcgccacacacgcgccgcgccggccgtgaccggggaatagcgagtggggagagtaatggccactgacacgtaggcttggctttctctgggacgggcgggtcccgtgcttggaggtgaaacatttcggttggtgggaggccggcgcgctgtatctgagtgtgaggcctaccgggagggactggtggcgtcggtggtggcagtgaccacgcgacagccgacacttactttccttatcccacgtggccgccgccatcttgttctgccggcgttaagggaacgcagggatgttctgggcttgcgcagtggcacaaaatgacgggcgtggcggctatgaatgtgagagcatgcgcaatgtggccccctaatggtggctgcgctgagccagctcctcagattaccaccttattggccgcctttctcagcttttctgtagttacccatattttgttcctctttcttgtctattttctgtgctttttctctgctttccgtctcgctattttctcacatctccattttctttctccttcctgccaccattcttcatgttcttcccacaggacttgaactgccatgtcctctgaagaaggaaagctcttcgtgggagggctcaactttaacaccgacgagcaggcactggaagaccacttcagcagtttcggacctatctctgagggtgagacgggccatactcacaatgggggttggtgagagaaagtctgggatccttgcatttcaaggagtattaactgaaaagttaggacccacgcctccaaattctttttcttcctaagcctatggtgtagactaaggatgaggggaagcgtctttgggattagtgggagcgctccgttttccctacctatgccatctccttttccggccaccctttgctacttaacctttggggtactgactggtccacattgctccatcttctctccctctcacagtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtgagtgcagtgatcgttttgatcatggggtgagagggagagttgcctatgtgtggacaactgccatttaaatatttttctgctctaggtggtggggaccagggctatgggagtggcaggtattatgacagtcgacctggagggtatggatatggatatggacgttccagagactataatggcaggtgggtagccaaagggctgggatgttctcctattgcttccctctccttaagaactcagcgcctgggtgttcatgcataccacaccttgctgttactaatgtgtacctaaaatgagtatgaaatttagcattttaagttaattgtgtagtcatatagttgcgacatggtaaagtatactatatatgttgtgctgtgtgggttatataactatattgctttaacatgtaatatgatttaatatactgcgtataaatcgtatgccataaaactgtttactgtgatactcatatgcttaacatatcctgtttttgatacgtaaggtttatgttatgacccatactgtaaaatgtgacgcatataattacagtggtatatataatgcagtaccagaaaacttttgtgtgttttttttcccccccagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaaatggcacatcaacgagagggaggcttggagaatatttggttggtgggtgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatcttttttggtgtgtgtgtgtcttgggtggtaaagtggtaattttgtaattctagctggtcttagttcctcagttctgctccctttagtcatggttctttctagtggctgtattgaggccccatgggtgttatccctccattggttctagtttggaacagaaaaatctgttgtattcatggctttcacctggctaatactgagctaagttaccaccaggttgcaaactccaggacattattgtcctgagctgcctattcccttgctggtgcgttgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttggtctcctactttggtttgtcttcagcatccaactgatgcacatttgtcaagaacccactgaggctagaaaccccccaaacactcaaggtaccttgagaacatgtatcccaagacctgcaaagaccaaacacatggcctgtaactacttttcactttcaagccctggaacttgtctgtaccaaaaatctttctgaaccattcaccaaatctcttgtcaagggccagaataaattaagagattggcttttggttttcaattaggctttcaagtcctaagcccaacccctcctatcccacctaggcagaaatcacttcagatccttgcttcctagtttaatttcttctctgcctcagttataacatccataaaatggaaataataatacccacctcacacaggggttaggagtgtttttttgttggtttttttccagacagggtctcactctgtctcccaggctggagtgcagtggcacaatctcggctcactgtaccctccgcctcccaggttcaagcagttctcatgcctcagcctcccaagtagctgggattacaggtgcctgccaccacgcccggctaatttttgtattaatagagacagggtttcaccgtgttgggcaggctggtcctgaactcctgacctcaagtgatccacccgcctcggcctcccaaagtgctgggattacaggcgtgagccaccacacctggcctaggagttaagagtattaaatgttaagaacagaccaagtccatcaaacagctccacacccttgttccatgttctggattggggagttgtgggggtggaggtgtagaacttttaaaaagcttcttaaaataagttgctgtgaatacttcaggtatataaaaaaacattggttgacaataagccagtgttctgccattcttacctgcttatcaagacaaaacctgctcaagtccctgcccagctgcattccaagtgttttcaagtttggtggtaagacctgacctgaggcttcttataacctttactcagtgggaatatgcatacagttcactacagaaatatttgtatttacttagaggaagtgccctggatctgggggcgggggggggcggggggaatgggtcttttctaaattgttaaaagcagttcatgccattattcttaataaacatttctaatatgctgtgaaagagtatattcgtttttttaatgcatatatccatttactcattgttcccatgaaagagccttgtatgcaaacctccaaatgccgaaggagccaagaaacaaggcagacaaaaattgttagtaaagggttctttactggggggacttagaagcatgacgtggggacgggcgcagtggctcacacctgtcatcccaacactttgggaagccgaggtgggtggatcacctgatgtcaggagtttgagaccagcctggccaacatgatgaaaccccgtctctactaaatacaaaaattaatcgagtgtagtggcgcacaccaagtaatcccagcttcttgggaggctgaggcacaagaatggcttgaacccgggaggtggagattgcagtgagcccagatcgtgccactgcactccagcctgagcgacagagcacaactgtctcaaaaataagcatggccttgggtggcagcaagataaccatgctgttgctcttcaacccacggcttacataccatagggaaagagtgtgctcaagatgaaggcaactccagaacaggcataatactctatgcatcatcatctaatttgtgcgataatgtaaaagttgacaagctcttttttttttttttttttttgaaacggagtctcgctctgtggccctggctgtggcgcgatctgggctttctgtggcccaggctggagtactgtggcgcgatctgggctcactgcaagctccgcctcccgggttcatgccattctcctgcctcagcctccggagtagctgggactacaggagcccgccactacgcccggctatttttttgtattttttagtagagaggaggtttcaccgtgttagccaggatggtctcgatctcctggcctcgtgatccacccgcctcggcctcgcaaagtgctgggattacaggcgtgagccaccgcgcccggcccctgacaagctcttaaactagggatggcaaaggaggaatcaggcatttacaggactggcgctagtcagaagtaaacgtggtggattggcatccaagatggagtaacttttgtctccacactcttgctgaaggctggaaaatcagcatgtgagtctgtcttgtaaaaggtaattgggcatgcgctactcaaaaaatcatttggggcccggtgcggtggctcacgcctgtaatcccagcactttgggagtcccaggcaggtggatcacctgaggtcaggagttcaagaccagcctgggcaacatggtgaaaccccatctctacaaaagtacacaaattagccaggcctaattgcaggcacctgtaatcccagctactcgggaggctgaggtgggagagttgcttgaaccagggaggcagaggttgcagtgagccgagattgcgccattgcattccagcctgggtgacagagtgagactctgtctcaaaaaaaaaaggaaaaccatttggtaaaggagaaagtggagtcctagacgggggagttcagtgtcagcctgcattgaaatcatccggtttatgggacttggttgccttgtgtgctggcttggactccatggtatccaaagtgcacagtgcatgaaacatgaagaatttgcaacttaacatcagtttatatgttgctatccaagtttatctaccatgaggcttaactcatacaaaaacctttacttagggaatgtgcctacttgagaaagcaagttcacctactcatcatccagctattttccttgctagttatcatagataacatgaaaagattttttagagtttacccatgtccttcaaattatcccacacaaaactgcttagaatgtgttaaactatattgatgatttaaaaacaagcacaacaacataaagacagaatcttcctctatttcaggagaaatgatttactgtgaatttaaccttttaacatctttggtgttaattgtgggtgaaccaggatggctgcttcctgtctcgttctatgatcctcaccctgatcttgttcagacagcgtcgctcccatgtacaacaccatagtctctacagtgggagccttaaaagggccctcttgtttccctatctgtcgtctgacttctgcagtgtccctgcccaccttctcatagcagtggccccaaaggacatgtttctgttacaggtgatcacattcagaacaaatgtctatattttttaaatgtaagtacatctgggctgggtgcggtggctcacacctgtaattccaccactttaggaggctgaggcaggaggaacgcttgaacccagaagttccaaaccaacccgggcaacacagtgaggcgcacccgccacctgccccctgcccctgttaaaccaaaataaaaattagccgggtgtgatggtgcacgcctgtggtcctagctacttgggaggctgaggtgggaggactgcttgagcctggaaggtctaggctgcggtgagtggcattttggcctgggtaacagcgagaccctgtctcaataaaaaaacaaaacaaaacaaaacaaaaccgcgtaatattcaccctatattcacactgtcaatattcacactataagatcaattaatgcccctactataagcttgtttagcaaatcttttcttttactttttttttttttttgagatgacatcttgctctgtcatccaggctggaatgcagtggcatgatcacagctcactctagcctcgacctcccaggcttaagcaatccccccacctcagcctccagagtagctggaattacagggatgcatcacccatgcccaataatcttttttggtttttgtagagacagggtctcactatatttatgttgtccaggatggtctcaaacttctggactcaagcaatcctcctaccttggcctccaaaagtgctaggattacaggtgtgagccaccatgcccagtcttatttagcaaatcttttctggattattagtccttttttgatggaaacttttcacattaattttttgcccagctcttttgaggtgtggttaaccaaaaaaaaaaaaagtatatttaagatgtataggccaggtgcagtggctcacgcctgtaatcccagcactttgggaggccgaggtgggtggatcacttgaggtcaggagttcgagaccagcctggccaacaaggtgaaaccccatctctactaaaaatacaaaaattagccaggtatggtggcgcatgcctgtaatcccagctacgcgggaggctgaggcaggagaaattccatgaagccaggaggtgcaggttgcactgagccgagatcgtgccactgcactccagcctgggcaacaaagtaagactccatctcaaaaaaaaaaaaaaaagatgtataacagggtgtttgataaatatacacatttaaaatgatcactacaataaagcaaattaacacatctatcaccttagttacctttattgtgagtgaaatgagaacacttaatcatctacttagacaatttcaagtatacaccacagtgttattaactatagtcaccatgctgtacattggatctccagaacttactcatgttataactgaaagcttgtacccattgaccaaaaattcccccagcccttagtaaccaccattgtactccatttctatgagtttgactttttttaggctgcagatacaagtgagatcatgcagtacttgtctttctacgagtggcttatttcacttagcataatgtcctccatccatgttgcaaatggcagaatttccttttttaaggctgaataatattccactgtacatatacacatcatttactttatccactcatctgccatggacatttgggttgtttccacgttttggctattgtgagtaatgctacaatgaacatggaagtgcatatatctctgagatagtaatttcataacttttggatatatacctggaagtaggattgctggatgctatggtagtttatttttttttattattattatttttttagacagagtcttgttctgtcgcccaggctggagtccagtggtgcgatcttggctcactgcaagctctgcctcccgggttcacgccattctcctgccttagcctcccgagtagctgggactacaggcgcccaccaccatgcccggttaatgttttgtatagtagagacggggtttcaccatgttagccaggatggtctccatctcctgacctcatgatccacccgcctcggcctcccaaagtgctgggattacaggcataagccaccatgcccggacttggtagtttatttttaatgttttgtggaacctccacacaattttccctactagctgtactaatttacattcctacaatagtgtataggagttcccttcagcacttgttatctttcctatttttttttttttttttgacatggaatctcactctctcacccaggctggagtgcaatggtgcaatctcagctcactacaacctccgcctcctgggttcaagcgattctcctgcctcagcctcccgagtagttggtgttacaggtgcccaccaccacacccagctaatttttgtaccttaagtagagatggggttttgccacgtcagccaggctggtctcgaactcctgagctcaggcaatccacctgcctcggcctcccgaagtgctgggactacaggcatgagccaccatgtctggtcctttcctcatttttatagtgaccatcctaataggtatgagttgatatctcattgtggttttgatttgcatttccctgatgattagtgatgttgagcccctttttgtatacctggtggccatttgtatgttttctttggagaaatgtcttttcaggtactttggctattttaaaatcagtttatttggggttttgctattgagttatatgagttccttatatattttggatattaatcccttataagataaatggtttgaaaatattttcttccattccataggttgccttttcattttgtagattgtttttcctttgctgtgcagaaattttttagtttgatgtagtcccacttgcttatttttttaacacagagtcttgcccaggctagagtgcagtggcacgatctcgggctcaacctccgcctcccaggttcaagcgattctcctgcctcagcctcctgagtagctggaactacaggtgtgcaccaccacgcccggctaatttttgtatttttagtatagatggagtttcaccatgtcagccaggctggtctcgaactcctgagctcaggcaatccacccacctcggcctcccaaagtgctgggattacaggcgcgagccaccacacctggctgtttatttttgcttttgttgtctgtgcttttggtttcatgtccaaagaatcatcgataagaccaatgtcgaggagttttcccccttggtttccttctaggacttttatggcttcagatcttatgtttaagtctttaatccatttttagtttttgtgtatggtgtaagataagggtccatcatttttcccagcaccatttattgaagactgtctttcctccattgtgtattcatagcacttctgtcaaagattagttgatactagctgggcgcggtggctcccctctgtaatcccagcactttgggaggccaaggcaggcggatcacgaggtcaggagtttgagatcagcctggccaacatggtgaaaccctgtctctactaaaaatacaaaaaaaaaaaaaaaatagccgggcatggtgacacatgcctgtaatcccagctacttgggaggccgaggcaggagaatcgcttgaacccaggaggcagaggttgcagtgagccgagatcgcacctctgcactccagcttgggcaacagagcaagactccgtcttgggtggcgggggataagattagtttatattgtatgtgtgggtttatttctgggctctcttgggttttgggggttggtttttgttttttgtttttatcaggcagcctcccaagccagagtaggctcagagagactccctattttctgggcccttgatcctgttccactgggtgtgtgtgtgtgtgtgtgtgtgtgcatgcgtgtgtgtgtgtttaaagagggtcttgctctgttgcccaggctggagtccagtaacacaatcacagctcactacagtctcgaactcctgggctcaagcagtcctcccacctcagcctccccagcagctaggactatgagcacacaccaccatgcccagctattttttttttttttgagactgttacactcttgttgcccaggatggagtgcaatggcgcgatctcggctcaccacaacctctgcctcccaggttcaagcaatcctcctgcctcagcctcccgagtagctgggattacaggcatgcaccaccacacccggctaattttgtatttttagtaaagatgggggtgctccatattggtcaggctggtctcgaactcctgacctcaggtgatctgcccacctcggactcccaaagtgctgggattacaggcgtgagccaccgcgcccagcttattttatttatttttaaatgtataattaaatttttattggatatagtcaccctattgtcctgtcaaagactagatcttattcattctttctattttttgtacccattaaccatccccacctcctcccacccccactaccatttatctgactttggcatcagggtaattctgttctcataaaatgagtttggaagtgttccctcttcttcaattttttttttccttttttgagacggagtctcactctgccgcctaggctggagtggtttgatctcggctctcactgcaacctccacctcccacgaccaagcaattttcttgcctaagcctcctgagtagctgagattacaggcacccaccaccatgcccggttaatttttgtatttttagtagagacggggtttcaccatgttgaccaggctggtcttcaactcctaacctcaggtgatctgcccactttggccccccaaagtgctgggattacaggcgtgagccaccgtgcccgtcctgttgggagatttttgatgaatgattcaatctccttacttgttatcagtctgttcagattttctattcctgattcggtcttggtagagtgtatatttctaggaatgtgtccattgtttctaggttatccaatttgtgtaacaactgttcatagtagtgtttagtaggcttattattattatttgagatagggtctcactctgtcgcccaggctggagtgcagtggcacaatcacggctcactgtagcttcaacctcccaggcttaagtgatccttcccgcctcagcctcctggatagctgggattacagacacacatcaccatgcctggctaggttttgtatttttagtagagatggagtttcgccgtgttggccaggctggtctcgaactcctgacctcaagtgatcttcccacctcagcctctcaaagtgctgggattacaggcgttagccactgtgcctggcaggtcctttgtttttctgtcgtttcacttgtaatgtttctgattttatttactttgttcatcttttcaaaaaaccaactcttagtgtcattaatcttttatatttttttcatctatttcatttatttttgccctgattttgttatttccatctttctgctaactttggacttcattatttttctagtcccttgaggtataaagttaggttgtttatttgagatctttatttcttttttcttttttttttttttttttttttgggacagggtcttgctctgtcacccaggctggagtgcagtggcaagatcacagctcactgcaacctccacctcctgagctctagggatcctcccacctcagcctcccaagtagctgagactacaggcgcacaccaccatgcccagctaattcttttattttttgtagagacaagggtctcactatgttgctaaggctggtgttgaattcctggccacaagagatcttcctggcggggtgcagtggctcatgcctgtaatcctagcactttgggaggccgaggtgggcaaatcacttgaggtcaggagtttgagaccagcctggccagcatggtgaaacccctctctactaaaaatacaaaaaattagccaggcgtggtggcaggcgcctgtaatcccagctgcttgggaggctgaggcaggagaatcgcttgaacctggcaggcagaggttgcagtgagcagagagagtgccactgcattccagacagagtgagactccgtctcaaaaaaaaaaaaaaaaaaaacagctcttcctgtcttggcctcccaaagtgctggaattaacaggcatgagccaccgtgcccagccagaagtgtattgtttaatttccacatattggtgagtgttctgattttcctccttttattgatttctacttttataccattgtggtcagaaaggctcttgatatgatttcattcttcttaaatttgttaaaacttgattttgtgaagtttcattatatcatgcattggtggggtccacctacaataagctaaaacattgccgtgtaatgtaatgttagggagtgggaagcattaagggaaataaagcagggtgggggtggagagtgagatgtgatggtttacacatggcagtcagggaaggtgactctgaaaaggtgcctttcaacagagacccgatgttcgagggagagcagtcaaggaggatatccagtggtctagttcgtgggaatggttcctccatagcgctctggctccgttgcacgtctccacatgggccacgtaggtaagctgatgtaagtcttggcagaacgccctgtaatcctcggaacacagagcacggaaggtctgtggggaattctcacgaggccatttaccattcacctcctatctaccaaggagcctgttgtgagacagttttctccccacctcctgaggttctggtggggtttgaggctttctacccctcacctctgggctatagaactgcttagctgcagcatgaaattagctcctcagcaacaaggtgtcctgccacctggtgtgtggtcatctcgcccctttcatttcggtgttgcccggcacaagggacatgaaccagaatctgtggatgttcttgctttcgtggtccacgtaagtaacatctgaatgtaactagggcttgtttcatttccaaccaaacctgtcagccttaccttgcttcgacatctggaagagaattaaaggcagagggaaaagcaaacaggtgcaaaggccctgaggcaggagcttgcttggtgtgtggggaacagcaagaaagccagcggggcaggagcagagtgagccaggggccagtggtgggtggtgaggtcagggagggcccggagggcctcgtgggccacggagaggactttggctttttctctgagagagatgagagccacggcagggctctgagcagaggagggccctgggctgacttgggttgcaacaggatcattctggctgccgtgaggacagattgaggagagggggcgaggacggcagtggtgaggaggctgctgcagtcatccaaaccagtgatggtggtggcggcagtggacgccgagaggagagctcggattctggcatattctgaaggtggaactcacagggtttgctgacagatcaagcaaagcgagggcgggatgacaaagtacttgttaggaatccacactagatgagctcacaaaaagtaacttgacagttggtgttagtgttgtggttaagaacagggattcggagccaagtggcctacatataaatccagttccattgcttactggctgtgtgaccttgggcaggtcacttcctctctttgttttcatttcctcacctgtgagatgagatggcaatagtatctacttcacaagactgctgttgtaaggattacacaaggttttctattaatgtaaagtgcttcaggctgggcacagtggctcatacctgtaatcccagcactttgggaggccgaggcgggtggatcacttgaggtcaggagttcgagaccagcctggctaacaaggagaaaccccgtctctactaaaaatacaaaaattagctaggcatggtggcgcatgcctgtaatcccagctactcggaaggccgaggcaggataactgcttgaactcgggaggcagaggttgcagtgaaccgagattgcgccattgcactccagcctgaatgacagtgagactgtctcaaaaaaataacaaattaaaatgaataaataaataaataaagtgcttcaaagagtgcctggcataaataaagtgcttgttattagtgacatgaccatgggatgagaagtgtcagggaagtgagtcatagcaaagagcattccagataccaggaacactttgtacagttttcaaagcatgtgacaggaagccagcgtggctggaacataacctgatggagtaagagtgccaagaggtgaggttggagaggaagcctaggaggagatcagcccctcacggtagctggacgccattgcagaccttggtgcatagagcagtcctggaggtcagaagagaccaggaacagaactagatctgggacttagtgctgggggtgcacagagctaggagaaggacggggcattattgtcaacaatgctggctggttaccagtggttggtggtttctggtgtccaggataagaaacagtctagttcgagcagtaggacaaatacctaacgcatgcggggcttaaaacctagatgatgcgtggataggtggagcaaaccaccatggcacatgtatacctatgtaacaaacctgcatgttctgcacaggtatcccagaacttaaagtaaaaaacaaacaaacaaaaaaaaacaaaacagttcgacttcccactggagtccaaatactagttctaatattgtctacatctgtggccatgggcagtaaacccctctagagttcactttccctatcttcaaaatggggcttaaatgtcatacctacctccttaggtttgtgacagtacatataagatcagtatagtcagcactcagtaatgcaggctatcaccacaaccaggtgggacctatcccaggacagcaagggtggcttgacatttgaaaagcatgagatgtagttcaacatattagcaggaaagaaagagaatcaagggctgtaattgcctgggactgtgatatcagatgcaagggctaaacactcccagatctgcaatctagccctgaatgcctcactgggcaagctgaattgagatcttaagaccagagtgatcctagtcctacccctgtgaagtgatttccgctggctctgaatccgtggccgacaggctttaacgtccgccttatcctcacgctcagcagtccaaggctttgtgcattctggtttcagttcaaatttatttttcacacctgccccccagcaacaataaccaaactactatttttttttttaagaagagtctcactctgttgcccaggctggagtgcagtggcgtgatctcggctcacttcaaccttcacctcccaggttcaagcgattctcctgcctcagcctcctcagtagctgggataacaggcacccaccaccatgcccagctaatttttctacttttagtagagatggggtttcaccatgttgagcaggctggtctcaaactcctggcctcaagtgatccacccgcatggcctcccaaagtgttgggattacaggcatgagtcgccatgcccggccaaactactatttcatttacaagtttaccaatttcttacattattattttcttactattgatcttggcagttagaatcgtagctccagggactgaagaagtatctgtcagaaggctggcttgctagttcagcacgctggggaccgcacagtgctccgtttgaggctttttccaaaggcagaaattttatttctgacttagggcatagagagttgtcaccaacccccatttgggggttgtgagaactttggcttcagaggcaaatgttttcccatcaggaaatgatgaaagttatgaactcatatcccaacccccactcaccccatttaggaagaaacttcagggatgagataagtgaatgaggattccgtgtctccactccaattacacctcagctccatggctcctcccgtttctctctctggccttgattctcagcacacctgtaccctgaaccacctacactttcccacctacacttttactttgtcctctgaagttggggcccaacttgagattttatttcagcctgtggtagcaatgaaaagcagacacagccaatgtggtccactgcgttcctttgcatttcttgtttttttttttttgtttgtttgtttgttttttttttgagacagggtctcactgcgttgcccaggctggagtgcagtggtgtgatcacggttcactgcagcctcaacttcgcaggctccagtgatctcccacctcagcctcttgaatagctgggactacaggtgtacaccatcatgcctggttatttttttttattttgtaaagatagagtctcaccatgctgtcaggcaggtctcaaactttgaaaactaaccgaaagcttgtaacaagcagaggaatgtttaatcaagaaaaaccagctgagtggctcatgcctgtaatccagcacttcgggaggccaaggcaggcaaatcacgtgaggtcaggagttcgagaccagcctggccaatatggtgaaacccatctctactaaaaacacaaaaattagcctggcatggtagtgcacgattgtagtcccagctacttgggaggctaaggcacgagaatcgcttgagctgggaggcagaggtgcccatgttggcgaggctggtctctaactcctggcctcaagtgacccaccctcctcagcctcccaaagtggtgggattacaggcgtgagccacagtgcccagccaacaaacctttcatcagcttgttttgtctagtatcttatagccttataggaagaggttttaaaaataatttttataaatttaatatgttaatattgaaaaacaataaaagaattcattccaatggtgaaacagaatttcccaggtatccctgactcgaattcctgactcttctgttatttcattccatcatatttctttggaagcagagtggtgggatgaaggggcagggctctgttgagagaaggtggaagtgaatgggaaaggtatttatcacaacactctttatggtgaaaaaagaacatggaaataaacccaatgccagtcacaaataggggaccagttcagggctgggtgcagtggctcatgcctgtaaatctcagctccttgggaggctgaggtggaaggatgcctcaaggccacgagttcgagaccagcctgggcaacatatcaagatacccccatatctctctctttttaaaaaaaacaaaaaaaaaaaacaaaaaaaaaaaacagggtcttactctaacatccaagccagagtgcagtggcatggctcactgcagccttgacctcccaggctcaagcaatcctcccacctcaccctcctgagtagctgggactatgagcacacaccaccacacccagctaattttatttttgtagagatgtagtctcactgtgttgcccaggctggtctcaaactcctagactcaagtgatcttcttgccttggcctcccaaagtattgggattacaggtacgagccaccatgcccagccgaccccatgtcgctctctcttttttaattaatttatgtttgagatggagtttcgctcttgttgcccaggctggagtgcaatggcacgatctcagctcactgcaacctccgcctccagggttcaagtgattgtccttgcctcagtctcccaagtagctgggattacaggctcctgccaccatgcccggctaattttttgtatttttagtagagacagagtttcaccatgttgcccaggctggtctcgaattcctaacctcaggtgatctgcccgcctcagcctcccaaagtgctgggattacaggtgtgagccaccacatccgacctctttttttttttttaagagacagggtctcgctctgttgcccaggttggagtgtagtggcatgatcacagctcactgcagccttaacctcccaggctcaagcaattcttctgcctcagcctcccgagtagctgggactacagggatgtaccaccatgcctaatttttggtagagatggggtctcactttgttccccaggctggtctcaacttcctggactcaagtgatcctcccgcctcagccttccaaagtgctgggattacagacataagccactacgcccagttgacaccatgtcttaaaaaaaaaaaaaaaaaaaaaaacgtaagggaaccagttcaataaaatgtcacccttgaattccctgggcttcagatatcctcatctgtaaaatggggatagtaacaggacccacaaccttcagttattatgattaaattgactgggtacagtggctcacgcctgtaatcctagcacttagggaggccgaggcgggcgaatcacttgagctcaggagtttgagaccagcctggccaacatggtgaaaccccgtctctaccaaaaatagaaaaattatccgggcgtggtggcaaatgtctgtggtcccagctcccgggaggctgaggtaggaggactgcttgagcccaggtggcagagattgcagtgagccaagatcgtgtcactgcactccagcctgggtgacagagtgaaaccccatctcaaaaaaaaaaaaaagattaaatagattaatatatgtataaaataccttgaacagtacccagcacattgtctcataaatattagttgttcttgttaaggttacatgtttgtgcagtgaaatagagtttactctttatcaatcatgttacaaaagagtatttaatatgaaaagacactgataagcttgttacagggacaagggagatgctgagtcaacacaatacagtgtgatctttcggtgactttaaaacattgttgaattgattgtatttgttataaaaataatgtggaaaataacagctttgaattttatgtcagttgatgttaagatccaacaggaagtttaccctgataacgttaagatgaacagtttgaaagcagcttcctgctggaagttgaaatagagatgattcagatagcctctttggatccaaaccccaaagcttcttttgcctaattctatcttctgtctttagaaactcaagcctcgactgggctcggtggctcacgcctgtaatcccagcactttgggaggccgaggcgggcggatcatgaggtcaggagattgagaccatcttggttaacacggtgaaaccccctctctactaaaaacacaaaaatttagccaggcgtggtgtcggacgcctgtagtcccagctacttgggaggctgaggcaggagaatggcgtgaacccaggaggcggagcttgcaatgagccgagatcgcgccactggactccagcctgggcgacagagcgagactcccgtctcaaaaagaaaaaaaaaaaaaaaaaagaaagaaactcaagcctcaagctgtctgggggcatccaagtccaaccatcccagtcacacacacacaaccgaccttactcatcccaggggtgtgcagaggcccactgcaagaactggtgaactttcaaggcgtctttgcatatatgatgattttttattctattattcaagttttgcttggacaagattgtgctgctaaaaagtggcctacaccactttttttgtttttgtttttgagacagggtttcactcccgtcgcccaggctagagtgcagtggcgcgatctcagctcactacaacctccgcgtcctgggctcaagcaatcctcctgccacaacctcccgagtagctgggactacaagcgcccgccaccatacccggctaatttttgtatttttagtagagacggggtttcaccatgttggccaggctggtcttgaactcctggcctcaagtgatccacctgcctcggcctccctaagtgctgggattacaggcgtgagccaccgcgcccggccctacaccactttttaaaagtcgtgtttcttctcttttttataatgttgtacttctgatttctagggaatgattagcaaactcacccctgacgctatgtcccttggacattatccttgtatacacaaaaagtgcaattaacgagtgggtagaagtcaaggggtggagcctccgtccttgggcttgaagccaatgtccctcaatgcgcctgcgagactcccacgccctgggaaggatgcctatcgattcgctctgggctcggcagttctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagacttttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaacaggtcagtaaacatatagcaagccctgtctttagtatctgctgagcagggggagggcaggaacagcagaactcgtgaggaagccactgcagtagtacaagtgggcagcggtggtggtggcaggggacacagtgagaagtgatctgactctaggtagattttcagggctccacacctcaaaggttctcgggctttttgcaagatgcacccaccctgaccctctccatttgcaggactttgaggatgatcctcgggccctgggggcccgtgggcaccgtcgttctgtcagcagaggctcctaccagctgcaggcgcagatgaaccgtgccgtctatgaggacaggtatgcaccagaggcagccaaggcggggggcgggttgcgaggaggagaggggccctggggcaatggcagactgaacactctcgcatctacctcctgtcacccctcacttcctattggggcccaggccccctggcagcgtggtgcccacgtcagcagcagaggcaagtcgggccatggccggggacacgtcactgagcgagaactatgcctttgcgggcatgtatcatgtttttgaccagcacgtggatgaggcaggtgagccagtgggtagcgggttccatcaccaagcgtttgcccaaactgtgacaaccaaccaaggcatccttttctgaatccaaggcccctggcacactccaaaggaggaatgaccatccataaagccttttgtagactgaaaatccctctgcaaagtggtcagtgcttcgtctactggaaagggcctcagaagcctaagagagagccctttgcagcaggctgcctgggttcctgagtcacttggaagagttcaaagcctttgctgatgataaatccccttgcagagggcagagtgggctacagtgtcaagggttttgcaaattgccaagaccttgattataaagtgttcgctaagacaggaactttttcatgttgcagaagacttttgcaatctgcaaaggagctgctaagacttagggagctttggcagagggtcttcaggggttacagttccctttgtcagccaaggaaagccctttgctgaggccactgttcctcatgcagtggggccccagccccaggcacacacgtcagagccttttagagagaaaagtgcccagtgagtgtgcagattcccactaatggcttcttggcattgcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtcaggctccaggacacccactcaccaagggctggtgggctgggtcaggaaggctatctgagggaatcagagtataaggagggacagccagggggggcctaggacccccccaccccccacccaatctcgtcagagcagtcctagtgtggtcagacttaaaagggaagcagatcagaagacgggagtgggccaggcgcagtggctcacgcctgtaatcccagcactttgggaggcggaggcgggcggatcacgaggtcaggagattgagaccatcctggctaacacggtgaaaccccatctctactaaaaatacaaaaaattagccgggcatggtggcgggcgcctatagtctcagctacttgggaggctgaggcaggagaatggtgtgaacctgggaggtggagcttgcagtgagccgagatggcaccactgggcgacagagcgagactccgcccccaccccccataaaaaggggaatgccgttcttgatctgggttggccttgctgtggtacactccagggagcacgggccagggtcagggttctggctctggagcccctttggtcccatcagctacagtcctacagttttccaactgcaggggctacctctgaggagcaggatgatgaggctgagcctcgtctggtctgtcagtggccccaccgtgtcagactccagggtagattggtcagagagcaggggaaggacattagaaagtctggtgtggcccggggtgtagtggggtgaactgcagaggaacagaccaagagtgagcttgtgggccgggatcctccccgcattagcagcagccccacaagttccagaaaggagcagccagggagcaggggaaagctgggatcacaggcctaggcaggccctatggttctcacactgtaggaggactggccaaggggcagcatgatggctctgaaggccctttagtcccgtaggcaggtggcctactctgggcagattgcaaaaggggctggctagggaggtggattcatgcctggtcaccttgtctacctgccacagccctattgtgaatagactctaatagggaccagccagtcgcatcaacagcagccccactgtggtcagactcaaggagggcctggctggaagcaggatgatggtctgtgcattctccccacaggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacaggtaggcagacagcaggcctgcatctgggtgctcgccctccagccctcccagggcacagccctcaccctcacctttgccttccctccctctgctgctgcagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacaggtgggtcccccatcagggcctcctggagacggaggacctgcctcctccagcacactgggacagtagctcatctcctccatcaggttaatttaattgagggagcagtagtagcagtaacagtaatagcagtagtgagcgcgtttacagccatcactgtggccaggccctgttcgaagcagtttccacgtatcaccacattcaatccttgcaccgacctgtgaggtaggtgctgttattatctccattttgcaggtgagcaaactgaagcataaaatagattagggctacttaaagcagagacctgttttcctttcttccttccttcctttttttttttttttttttgcggggagtagtgtgggggttactgtccccactcacatctgtcatgttacccaaatgcagttctcagcctgggccacacattggaatgacctgaagagcttcaaaaactcctgtctgggcccctctacaggccagtaatttcagaagctttgggatgggcctgggcattggtagattgagaaattccctaagcaatgtctggccagtcctgaaaaccactgcctaacaggatgctttttattctacccctttatttctctcctcctttttaaacaatttctgtatatatacttaacaattttttaatttaagcgtacccttaagtttgcccatttcccacagcctctcctttcttcctcctgccacctctggcctcctcctgccacagtaaagcccattaatgatccacatctttccacatatccttctctttccacaaatcctaggcgtgtacatatatccatgtatgtttttgtttgtttgtgagacagggttttgctgttacccagattggagtgcagtggcatgatcatggctcactgcaacctccaactcctgggctcatgcgattctcccacctcagcctaagtagctgagattacaggcacacgccaccatgctcggccaacctttttaatctattttttgtagagatgaggttttgctgtgttactcagtctggtcttaaactcttggcctcaagtgatccttgtaccttggcctcccaaagtgctgggattacagacgtgagccaccttgcctagctcccaccacagttttgaaagaaagacgttttaaagaaatggccttttccggccaggcacagtggcgcactcctgtaatctcagcactttgggaggccaaggcgggtggatcacctgaggtcaggagttcaagaccagcctggccaacatggtgaatccccgtctctactaaaaatacaaaaattagctgggcatggtggcaggcgcctataatcccagctacttgggaggctgaggctggagaattgcttgaacttgggaggcggaggttgcagcgaggcgagatcgtgccattgcactccagcctgggtgacagagccagactccatctcttaaaaaaagaaagaaaaaagaaatggcctttcctacatttcgagtttctcaccaggcaatgccttgtggaaacccccccaggttacctgtggggacagtgttttattctctctaagggctgtgcagttttccacagtgtgggcataccatggtgtgttcatttcctctctttgtgcttatcttaataccaggatcttttagagacccttacaaagaaaaactagtgaatgaaactgcagaggctcccatttatatcaacagagacagtttctgaaccatcagtaactcacacatcagcccctacttatagtttatgtagtcatctcagaattgggtttcataagctgggtgtggtgtgtgcctataggtagtcccggctactcgggagactgaggcgggaggatcacttgagcctaggaggttgaggctgcagtgagccgtgatcgcaccactacactccagcctgggtgacagagtgagatcctgtctcaaaaacaaaaaaaaaaatatgggtttcatgaaccctgtaaagaacttaggcacaggggtggggacacaggcccacaacttgtctccctgctagggctggggctgtgttttgacccactctctcatcctctcagggtggtagacaacgaggggaccctgcagctgaagagaagcttccccatcgagcagagctcacatcctgtgcgcagcatcttctgtcccctcatgtccttccgccagggggcctgcgtgggtgagtcctgtagggacaggggatctgggtggctggggaggggcaggaaccagggctggtgccaacctggctcagacatcacgacaccgatgccctgacttcctggacctcatgacccctcctgccccaacagcctcactgtggaactcacagctccaaacagctcagagaactcacagtttgcacttgatctcggccaaaaggccgagaagtgatgaaaactcacactttgaacgcactaactccccaaacagcccagagacctcgcattctgcacacagtaccaaaacagccaggtgacctcccatctagggatggggccccctcaaacctccccaagccatgctaggacctcacacctcggacatacacccttcaacacctcagacacctcagggacttcccaccaggggcaccccaggcgcctcccgatggcctctccctctcaccccgacagtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggttcattgactcatttgtgcattcatgcatcgacggattcattcattccacaagcattgattgaatgtctgctgggttacaggccctgccttaactgttttacacacttatgcattcgatagacattagtgagccctgaccgtgtgccaggaactgttctaggcactggggatactgctctgacctaaactgatggaaatgcctgccttcattgggcttgcatcatagcggagacagtagataaaaacatggaacaggccagctaatgatgagtggtatgaagaaaataaagcaaggatgggagacagagctgcagaagttgggggagtgggctctttatggtgacagcatcagggaagatgatcctgacagggtgacttttttgtttttgagacagggtctcactctgtcacccaggttggaatgcagtggcatgaccatagctcactgcagcctcaacctccagggctcaagtgatcctcacttaagcctcccaagtagctgggactacaggtgtgtgccaccacactcgggtaatttttgtatttttagtagagacggggtctcgccatgttgctcaggctggtcttgaactcctgggctcaagcgatccactcgcctcagcctcccaaagtgctgggattacaggcatgaaccaccacgcctggctcagggtgacatttaaagacctgaatgaagtgagtgggagtcatagtgtagggggagaacattccaggcagagagaaagccagcctaaaggcactgaggctggagcgctccagaaggatcattgtgtatgccagagtcttgctggaccagagtgtgacagtacatgaggtcagacaggccagatgcttcatgggccacagttaggactttggctttttttctgagtgggggtgaccagaaggtgtcaagcagaggaggaacatgatctgacttggtcatagaggctccctctggctgctgaaggggacagattgggggtgggggtagaagcaggggacccagcaggagacccctctgagcgcagtgatggggacttgcaccagggtagtgacagtggaggagttggcgggggaatgttgggtcggacccccagggggttcactatgttaggctgcaggactctgctgcctcctcagggggcgatattcccaacccttctgtgcattgtgttgtttattaaaagcagggagcagaggtgttgagtcctggagccccaagctggtgcaggagcaacgggaagttaaggctgacctggggcctcctgctgtgtggcggaatctccatccctcagaccacccctgtctcctcccagccccatccagggtacaaattccagccctggaacagctcagagaccaaaaagtgatgttaagtatttgaggggagccccaagagaggagaaaaagctttgagtattgatgggggtaaataaccaaaatcacttatcagtggcctgcgtcaccagaaaatgtcaaagttacctgaagcagcaaagaggctcttgctccggcccctcccttccttctcagctccatttgttgccacatatgcgttgactggaactgcgactgacatcttgggaccttagggtcagtccacagcgtggtagagactccagcttggcccagcattgctgagctgctgaactcgcaccaacagtcttgttggagggaaataatctcccgtttgttcagtccagttatttgacagtgtggttacttgcaccccaagcatttctaactggcacttccatctaatagacctcagggtacatggtggtgagatagggacatcagtgagctggattgttcccatggtaaaggtcatgtatgtgtgtgtgtgtcatggtcctcaataccagccccaagcccagtgatttgctaggaggactcccaagactcagtatgtggttgtattcatggctacgattgacttattacaacaaaaagatatggagcaaaatcagcaaaaagaaatggtgtgcaggaccaactcccagagagacccaggcacaagtttccagggcttctctctcattggagtcacacaagatgtgctcggttcacagtaatgggttgtgacaatacatgcgaaatgttgctgaccaaggaagctcaattagagactcagcacccagaggttttttttgttgttgttgttgttttggtttttttttggcgggggggggggggtcttgctctgacgcccaggctggaatgcagtggcatgatcttggctcactgcagcctccacctcctgggttcaagcgatcctcgggcctcagcttcccgaatagctggaactacaggcgcgcaccagcaagctcggctaatttttgtatttttagtagggatggggtttcaccatgttggccaggctgatcttgaactcctgacctcaagtgatcctcccacctcagcctcccaaactgctgggattacaggcgtgagcacctggctggtatcaagtttttattggggcatggtcacataggcaccccctgcctggcacctacccaaatcccaggctcccaaaaggaaagcaggggctcagcataaaccacctttttttttttttttttaattgagacggagtctcgctttgtcgccaggctggagtgcagtggcgtgatctcggcttactgtaacctccgcctcctgggttcaagcaattctcctgcctcagcttcctgaatagctgggactacaggcgcctgccaccaccacgcccagctaatttttgtatttttagtagagacggggtttcaccatattggccaggctggtctccatctcttgaccttgtgatccgcctgcctcgacctcccaaagtgctgggattacaggcatgagccaccgctcctggcccacttttttatacaaacagcttaggtagagtaagccattcttttttttctttctttctttttttttttttttgagacagggtctcactttgttgcccaggctggagtgcagtggctcaaacatggttcgctgcagcctcaacctcccaggctcaagcggtcctgctgcctcatcctccaaagtagctgggaccacagacatgcaccaccatgaccccagctgatttttgcagagatgggttttgccatgttgcccaggctggccttgaactcctgggctcaagtgatcctctcaccttggcctaccaaagtgctggcgttacaggtgtgagccaccacacccggcccgagtgagccattcttatctcttagggaatggtgggaaccctcctggagtctatgttcttagacaccacccaagggccaaccttgaagcaggcctttccaaggatcgcagttgaggcctgctctgttactgtttttctgcacagtgtgcaacaccacacagatgcccagtttctaccaaggtctgtggatggcaggataattttgaggaacctcctttttcgctaacactttcttcttttgtttacactcttcacattgtctattgagtctggattcaagatgattgattgtgaatattgttgtgcatgattttgggggtttcctccttgtgaaattttgaggtggcagatttgacattctactttaaactcatcttggtggcacttttcttgactcaccacctaagggggaataaataatgaagaaagaataaaaatagtgttatcagtcacatttgggcctcggttaacttgttcagcatcactggtttcacatcagatctgaagctctgtcaatcattccactatcaattccactctggtcttgcctcaaatcgaggcttcgattaactgttccctgccctttgtctgactttgaacctgtgtgtttgtcaactactttaccatcaagagcctctctgggccaggtgcagtggctcacacctgtaatcccagcactttaggaggccaaggcaggcggatcacgaggtcaggagatcgagaccatcctggctaacacggtgaaaccctgtctctactaaaaatacaaaaaaattagccgggcgtggtggcacgtgcctgtagtcccagctactcgggaggctaaggtaggagaatcacttgaacccgggaggcggaggttgcagtgagctgagatcgcgccactgcactccagcctgggtgacagagcgagactccgtgtaaaaaaaaaaaaaaaaaaaaaatggctgggctcgatggctcacacctgtaatcccagcactttgggaggccaaggtgggcagatcatgaggtcaggatatcaagaccatcctgtccaacatggtgaaaccccatctctactaaaaatgcaaaaattagctgggtgtggtggcgcgtgcctgtaatcccagctactcgggaggctgaggcatgagaatcacttgaacccagcaggcagaggttgcagtgagccgagatcgcgccactgcactccagcctggcgacagagcgagactaaaaaaaaaaaaaaaaaaaaaaaagcctctctggtctcagaacgaagctgggcctttgttaactattaccccactggtgtaccactggtcaaatctcaaaccagggctactgtataatatttcactagcaattggcttctgatctgaccttgaactgaacttgggtttctattaactactgtattttgtgacggtgcccttttgctccattccaacctcgaggaccctcagtcctgacgttacatctgggcctctgttaattatgtcaccaccaatgcccttatggtgtcaattccagtctgcacttctgtattaacggttgcaccactggctgggcaggcacagtggctcacgtctgtaatcccaacactttgggaggccaagatgggcagatcacctgaggtcgggagttcgagaccagcctgaccaacatggagaagccccatctctactaaaaacacaaaattagccaggcatggtggtgcatgcctgtaatcctagctactcgggaggctgaggcaggagaattgcttgaatccgggaggcgtaggttgcagtgagccaagatcacgccattgcaccccagccctgggcaacaagagcgaaactccgtctcaaaaaaaaccccaaacgacaacatcaccaccaacaacaaaacagttgtaccattaatgcccatggagtctaaacttaagcccaggcctctgttaactagtctactatcactgactctttggtctgatctcagacctgggcatctctctctttttttttttttttttttgacacagagtctcgctctgtcgcccaggctggagtgcagtggtgccatctaggctcactgcaagctccgcctcctgggttcatgccattctcctgcctcagcctcctgagtagctgggactacaggtgcccaccaccacgcctggctaatttttttgtattttctagtagagacagggggtctcaccatgttgaccaggatggtctcgatctcctgacctcatgatccgcctgcctcggcctcccaaagtgctgggattacaggcgtgagccactgtgcccggccctgggcatctcttaatgtttctttcaccagtacctatgacctcaaacccaggcactttatttatttatttatttatttattaagacagagtctcactctgttgcccaggctggagtgcagtggcacgatcttggctcactgcaacctcttgctcctgggttcaagtgattctcctgcctcagcctcccgagtagccaggattacaggtgcccgccgccaagcccggctaatttttgtatttttagtagagatggggtttcaccatgttggccaggctggtctcaaactcctgacctcaagtgatcctcctgcctcggcctcctaaagtgctggaattacaggcatgagccaccacgcccggctgaccttcatttgatattctagcttaaaggtccttctggtctcgaatcaaacctggacctcggttcagttttcatccaacaatgccacatgggtaatgcctggtcttctttttaactattcaaccttcagtctcctctgatctgactttgaatgtaggccattttaactcacaccgtcaattggtctgatctcaaatctggtctactgttaagcatcaatgttcttctggtttgttctcaaaatctgggttctcttttcttttctttttttttttttttcagacggagtctcgctctgttgccagggctggagtgcagtggcatgatctcggctcactgcagcctccgcctcccaggttcaagcaattctcctgcctcagcctcccaagtagctgggactacaggcgcatgccaccacgcccggctaatttttgtacttttagtagagacagggtttcaccatgttggccaggatggtctcaatctcttgacctcgtgctctgccctcctcggcctcccaaagtgctgggattacaggcgtgagccatcgcgcctggccactgggttctcttttctagtcattccatattcaatatcatcctggtccctaatcagagctcttccactatccttgctctctagtctgtctgattcttaaccaggacttacatttcctatttcatatttaaagatctactagtctagttagccaacacagccatttaactatccccaaatccttccactccaagccttctcaaaccagtcttctgttaaatacaccaccaactcccatctggtttgaccttgaatctgatcctctgataactgctccatcgccagtgtcctgtggatctgtcattgaacttgtacagttatctcttccaacaccagtgcccctagagtgtgaactcaaactccaggctctgttaagtattctagactcgagtccactctgaactgacctcaaacctagatattcatttgattgtcctcatccctttttctctggtttgatcctaaaccaaggtctgtgttaactattacgcctggaatgttcctctagtctgagttcaagcattttctaactatcccaatatcaaatcccacctctttgtctatatatttaacagaataattaaagcagaactaattaaaactccttgcccctcttacttgacctcaaatctgggtgtctttattctatcatcagtgcttttcttgtctattattgaactctgtgtattaactctcctaacatcaatgtccgtgtctgactttaaacgatggtgtctgttcattcttccactataaattcctctctggtagtgttgccttccacacaggcctctgataaaactaccattgttaatgcccccttaaacaaggactttggttagtgagtttaccatcaataccttcccgtttgatttttttatttttattgagacagagtcttgctcttgtcacccaggctggagtgcagtggcacgatcttggttcactgcaacctctgcctcccaggttcaagcgattttcctgcctcagccttctgagtagctgggattacaggtgcatgccaccacgtgtggctttttttttttttttttttgagatagtctcgctgtgttgcccaggctggagtgcagtggcacgatctcagctcactgcaacctctgcttcctgggttcaagtgattctcctgcctccgcctcccgagtagctggtattacaggcatgcgccaccatgcccagctaacttttgtattttcagtagagacagggtttcgccatgttggccaggctgatctcgaactcctgacctcaagtgatccgcctgcctcagcctcccaaagcgctgggattacaggggtgtgctatcacgcccggctgataccttcctgttttaaagcactgaccctggcatgtgttaactagtccatcacccatgccctattttctgaccttgaacttggaccattgttttgtttttgagacagagtttatttatttttgtgtgtgtgtgacggagtcttgctctgtcgcccaggctggagtgcagcggcgtgatctcaggtcactgcaacctccgcctctgaggctcaagtgattctcctgcctcagcctcccaagtagctgggactacaggtgagcgccaccaggcctagctacttttttgtatttttagtagagacagggtttcaccatgttggccaggctagtctggtactcctgacctgaggtgatctgcccgcctcagcctcccaaagtgctgggattacaggcgtgagccactgcacccaactggacaattgttaagtgtctctatatccatgcctcttcggttacactttaaacctgggcttatggcaaatacttcagcattagtggccttcagatctgaactcaaatatagaagattaaattactggacttataaggacttcagagtggtcactattaaggaaatgcagactgcagtcaggatataatggggtgagagactgcagtgtggacataagtgttcacagaaataaatgtgagttctagtggagtcacagactggcgtatggacactcctgtgatctatacctgacactgtgtgaccccaggagtttctgcaccctgctctgtgtgacaccagaagtagtcatgtcccagtatgtatgtggccaggagtgtccacattctagtctctgtggcctgaggattgttggcatcctggtccctgaacccgtaagttcacactccaatctgtgtgacccataagtgtccaaattcctgtctgtgtgaccccagaagtgttcatatcacagtcgatatgagtatctatacctagtctgtctgaccccagcatttccaaactgcagtctgtgtgactcatggggttcacatcccagtctgttatcccaagtatgcctacacccagcctgtgtgactctcagagcatcgaaacccgtttgtgtgatctcagaagagttcacatcctattcacaaaggagagaatagatattctttcatttctgctgctgataattagagaaatgtaaattcaattgttttttgttttttgttttttttgagatggagtctcgctctatcgccaggctggagtgcagtggtgtgatctcggctcactgcaacctctgcctcccgggttcaagcaattctcctgcctcagcctctcgaataggtgggattacatgcgcccgccaccacgcccagctaatttttgtatttttagtagagacagggtttcaccatgttggccaggatggtctcgatctcttgaccttgtgatccgcccgcctcggcctcccaaagtgctaggattacaggcgtgagccaccgcacctggcctcaactgtatttttttttttaacctaaaggtaaccacaagtggaatttaaaacagggataggttggcgcagcggctcatgcctgtaatcccagcactttgggaggctgaggtgggtagatcacttgaggccaggagtttgagaccagcctggccaacacagtgaaaccttgtctctaccaaaaaaatacaaaaattagccaggcatggtggtgtgtgcctgtaatcccagctactcaggaggctgagacaggagaatcgcttgaacctgggatgcagaggctatggtgagccgagatcgtgccactgcactccagcctgggtaagagtgagactttgtctcagaaaaaaaaaatgacaagggcactcagactgaatgaatgctcccaagaaataaccaaatgatatctgaatcaatatgattcagaaagtttttttaatgatgcataaaaatgcatgagaaaagtaaagagacagagaaaacagcagttgcaatagaaattcaagataaaattagggaaaaaagcattagacagtcaaagaggaccctttttattgatgaagggcatgatcaacattgaaaatacaagtcttgaattcctgtattccatacaagagatcgaatctttagctagaggaatggaagacagccaattgaatcctagccaaacttatgcatatggtcggatcaaattgaggaatcttcacagcagacactaaaaattgaaatgggcctatcaattaggtttagtggacaatggaggaaaagcgaggaagtggacacatggtttacccattttctctccctggacccaagaaaggatactttggtgaccttgggtgttctcccttgcagtgaatataagtggctacagtacaatgttgagcgcccctatgagaccttgacatgactacactaagttcattttcaggtgcttattcaaaggggaagtcactgatggcaaattctacctcacaacctcatctgtatagaaaagatgtgccatgatcgtgccactgcactctagcctgggcaacagagtgagaccttgtctctaaataataataataataaattccaaaacaaaacaaaacaacaacttatagtggccataagctcaagaccacaatgcaatcatggttagaaattagtactcaattgtacagaagaagccattaagcccctcctaccacagctaactgagattccggctggtggctctgaggctttgtcctccatctgtccatggtgatgctctagcatttcataacagggttggtctggtcagctctcaacacatcaacataacttactcttgcatccgagagattattcaagtgccaagtaccatcactttcttcttcttctttttttttttccttgagacaaaatcttgctctgtcacccaggctggagtgtagtggcgccatctgggctcactgcaacctctgcttcccgggctcaagttattctcatgcctcagcctcccgagtagctgggaccacagatgcatgccatcacgcccagctaatttttgtatttttagtagagacaggttttccacattggccaggctggtctcgaactcctggcctcaagtgatccacccaccctggcctcccaaagtgctgggattacaggtgtgagccaccacacctggccactatcaactcttcattgttgagtttttctaagttaaaacaacctgttttttgagctatgctgcatattacatgtttcaggaactccccatagactgatttcccagctccagaaacatgcaatccatctgctattcccttgggctttttgctttcttctttattttagagatgggggagggtctcactatgttgcccaggctggacttggcctcctgggctcaagagatcttcccacccctgcctctcaagtagctgggactacaggtgtgagccactgtgcctagctttttgatatcttgattccctcagaaccaggtggaaacatgttctgaataaaagccagtcctgggtattcttgctctactcaccggcttggttgtgttgggctgagccttatagaacacagtgctggagaccttctcagggtcacttcctgtacccttgactttgagctgcagccctctggttttctcaggtgagttttcttgactctttccactactcttcagccgataaagtgaccattccactcatgtgctttcccctggggtaactcctagtggatgcagtgttgggaccccttagtttcactgggcagtgtcacagggcaggctctttagaagcagaatttcagctggagtttggggcacaggaggtttatcagttgatgtaaagggaaggaggaggaagcaggatcgggcagggggagagctgagtatgatgcaagccacacaaagccttggccagcccagcggggagctctggagcagggatggcgtggcagagtgttttggggtaaagggcatgagcttggggaagtgactttctgcagactctgatggagctgacatctggaggctgcctgcccaccgcactccctgcagctgtgcagcgagcctttccttgaaaaggggtctcagtggtgcacatttttttttgagacagagtcttgctctgtcgctcaggctggagtatagtggcatgatctctgctcattgcaacctctgcctcccgggttcaagcgattctcacgcctcagccacccaagtagctgagattacaggcgtgcaccaccacacgtctctactgtttttagtagagacggggtttcagcatgttgaccaggctggtctcgaactcccgatctcaagtgatccgcccgcctcggcctcccaaagtgctgggattccaggtgtgagccaccgcacccagccagtggttcacatctttgtctcccactgtcaggaaaggtatggggaggagctgtgaaaagaaatgggtggccactgggtaagtaactggggacccagggaaaatcctgttactcccatgactcgcccacatggtcctgagccagtcactttaccactctgtgcctcagtttcctcaagactcagttgagggttggggagtatatccattcattcttctgacctatattgactgagtacctacatgtgccaggcactgtgccaagttataacagtcaacaaggcacacaaaacctcgccctcagggagctgacattgccaagaacccctcaaatctacccagtgacccagactgagggcagatgtcacccctggccttgcttgcaatgatcatgacgcacagtgagcaccgtggcctcgttgcatattcagacagatgacagcctgacatggaagctgaggatctaatcagtggcatccacatggtaacaggaaggaaggagccactgtgggtccttgagcaggagcacggagatatcagtgcaaaacttcagaagggcaattccagtggcaatcaatagaaaaagacctttttactgcatgtcaccctgccccttaggtgagtcaaattaaggcaaatagccgaggccaggccaccctgtctgtcccctgttatatttttggttttggtttgtttatagctgagttattccctagtggtggcagtgatgattgggaatttggctttctgatctgaccatttggtgacttctgggaatgaatgaacggatgttggcagagaacagcaggagtcaggcatgttatcctgtgtctcttggatctcttgccctgtggctaacggtgtgaaaatgaagcattaagctccctctgtggctgcagtcagactcctggggtgagtgagtaatgttttcccatctctggagggtgtctatacattattttgtaatgtcacttgaattaaaggaactcagttctgattggctgatagagataaataagcacttatacaaatcaaatattcctaaaatttaggaaaatgaggaaatcagactttttaaatggctgtcctctgtagtccaggaagaaactgaacttttagtaccgtaaatgcactagtcttgaaaaagattcctccttcagaaactaattcagagactttaagaatccaagttctcataattaagataaatctttggcaaatgacattagtttaattatttgagtttaataaaaacagtataggatgggtgcagtggcttatgcctgtagtcccagcactttgggaggccaacgtgggagaatcccttgagcctgggagtttaagaccaacctggccaacatggcaaaaccctgtctctaccaaaaatacaaaaattcgccagtagtggtggtgtgcgcctgtagtcccagctacttgggaggctgaggtgggaggatggtttgagcctgggaggcagaggttgcagtgagctgagatcatgccattgcactccagctggggtgacagagccagatcctgtctcaaaaaaagcaaaaacaaaaacaaaaacaaaattatgctattattaagtaattatcctgtaattattatggatgctttctctctgatttgttagtgttaagtataatacaagtgtgcatttatctacttaagtttgtattttcctaaattgatgaaggtttactgatcaaataagctaccacttctcctccataatgttgaagattacaaaaaatgtatccttgcatttgactaaaataaatcattaatctaataagtttatttcaacgtaattatgttttgtagtacgtcatcttgaagataacttccaagatctttaggtaattgaaaattctgactgatactcaattgacttaattaatggatgttcactggatgcccagagcatttctaagtaaggaagaaaacggaaacactgattactaagcacaattttaaatttgtataattttgcttattattatttttaaatttaattcaatttattttaattgagacagggtcttacttcgttgccctggctggaatgcagtggtgcgaacacagctcattgtggccttgacctcccaggctcaagcgattctcccacctgagcctcccaagtagttgggactactggcgcatgccaccaagcccggctagttttcgctttttgttttttgagacagggtctcactctggttgcccaggctggagtgcagtggcctgatcttggctcactgcagcctcgaactctcaagcttaggtgattctcccacctcagcctcccgagtagctgggacaacaggcacacaccaccacacccagctaatttgtgttttttgttgttgttgttattgttgttgtttgagatggagtctcactctgtctcccaggctagagtgcagtggcgtgatctcagctcactgcaagctctgtctcccgggttcacaccattctcctgcctcagcctcccgagtatttgggactacaggtgcctgccaccatgcccagctaattttttgttgttgttgttgttgttgtatttttagtagagatggggtttcaccgtgttagccaggatggtctcaatctcctgacctcgtgacctgctcacctcggcctcccaaagtgctgggattacaggcgtgagccactgcgcccggcctaatttgtgtatttttttttagagagagggtttcaccatgttgcccaggcaggtctcgaactcctgaactcaagcagtcttctcgcctcggccacctgaagtgctgggattacaggcctgagccactgcacccagccatatttttgtattttttgtagagatggggtttcgccatgttgcccaggctggtctggaactcccaagctcaagcaattcacctgcctcggcctcctgaagtgctgggattacaggcgtgggccactgtgcctggcctgctgcttgtttgtatgtgctacagagaggccctgttttggggtctatcaatcaacatatccatttttgccacatcaagatgtcatataagggatgtgggccattctagggagctggtttaagtgtagccctgagcttggctagttgactaaaatgacatttcacaattatccacaccttggtgaagtcaaagttagttctatttaatctcttagggcttattaaagaccccaaagagctttgatttacgtgggttatggctattgatacttactgggttagaaattaaaacagaaaattgtaaatatttattgagtcatagtaataacaaatgcattaacatgtttaacataaagaatatcttagggccgggtgcagtggctcatgcctgtaatcccagtactttgggaggctgaggtgggaggatcacttgaggctgtagtcagactcctcaggtgagtgagcaatattttcctgtttctggagggtatccataaattattttatgaagtcacttaaattaaaggaactctgttctgattggctgatagaaataaataagcacatatacaaatcaaatatttctaaaattataggaaaattagaaaatcaaactttttttttatttcctgggcaacatagagagaccttgtctctacttttaatttttatttaaaagtaaaaaatgttgggtgtgatggtgcatacctgtagtcccaactatgtgggaggctgagatgggaggattgcttgagcccaggagtttgaggccatagtgagctatgatggttgctactacactcaagcctggaagacagagcaagaccctgtctcataaaacaaaacaaaacaaaaacatatcttggtattactatgaaatcagttctgacctttgggcccttgacatctgtcttcaagtaaagtgtcagtttgttccatgatatgaaacttggaaagtgaatgttatttgccttggctgataacccctgagttatggaggaagctatgcaatgtattcatgtcttaggtttgtttccttggcttacaacatacatggtgattcttttttttttgtgagacggagtctcgcttctctgtcgtccaggctggagtgcagtggtgcaatcccggctcactgcaacctctgccccctgggttcaagcgattctcctgcatcagcctcccgagtagctgggactacaggcacgcgccaccatgcccggctaatttttgtatttttagtagagatggagtttcaccatgttggccaggctggtctccatctcctgacctcgtgatccgcatgcctcggcctcccaaagttctgggattacaggcgtgagccaccgcgcccagcctgttattctttactttatatttaatctgcctagagaggaaagaatgttttactagaatagttttctgtgctttattttggctttagtatgtccttaatttttttggggggggcggggcgcagcgcggacagaatcttgctctgtcacccaggctggcgtgcagtggtgcccatcttggctcattgccacctctgcctctcgggttcaagcaattctcctgcctccgcctcccgagtagctgggattacaggtgcgtgcaaccatgcctggctaatttttgtatttttaatagagatgggatttcaccagttgcccaggctggtctcgaactcctgggctcaagtgatcaccccgcttggcctcccaaagtgctgggattacagatgtgaggcaccgtgcctagccaattttttttttttttttggagatggagtctcgctctgttgcccaggctggagtgcagtggcgcaatctcagctcactgcaacctccgcctcctaggttcaagtgattctcctgcctcagcctcccaagtagctgggattacaggcacacaccaccaggcccggctaatttttgtattttttttagtagaggtggggttttaccatgttggccaggctggtcttgaactcctgacctcaggtaatccacccaccttggcctcccaaagtgctgggattacaggcgtgagccaccgctcctggcctcgtgcctggcctattatgtccttaatttttgttttgttttgttttgttttgagacagagtcttgctctgtcacccaggctggaatgcagtggtgcgatctcggctcactgcaacctctgcctcctgggttcaagcaattctcctgccgcagcttcctgagtagctgggactacaggtgcctgccaccatgcccggctaattttttgtatttttaatagagatggggtttcaccgtgttagccaggatggtcgtgatctcctgacctcatgatccgcccacctcggcctcccaaagtgctgggattacaggcatgagccaccgcgtccagccctatgtccttaatttttgaagaaaagaaatacaaagaaaaaaattttctctcttaagtgatttataatcatgttactctctatccgtatttttatgttttattgtcactttggtcaccattattgtttctcaggtacctataatatcttactcaagtgtataaaactcctcttaatttttcttttttcctttttttttttttgagatggagtctcgctcttgtcgcccaggctggagtgcaatggtgtgacctcagctcactgcaacccctgcctcctgggttcaagcgattctcctgcctcagcctcccaagtagctgggattacaggtgtgagccaccatgcccagctaatttttgtatttttagcagagacggggttttaccatgttggccaggctagtcttgaactcctgacctgagacgatctgcctgcctcagcctcccaaagtgctgggattacaggcgtgagccaccgtgcctggtcttctttttttttgagagggagtgtctcactctggcgcccaaactggagtgcaatggcatgatctcggctcactgcaaccttcacttcctgggctcaagcaattctcccacctcagcctcccgagtagttgggattccaggcacgtgccaccatgcccagctaatttttgtatttttagtagagacggggtttcaccatgttggccaggctagtctcgaactcctgaccttagttgatctgcccacctcagcctcccaaagtgctgggattacaggtgtgagccaccttgcctggccaagccaccatgcctggcttaggttttcatttttatcttcccaaagtcagacctaaatatagaaaaaaataaagtttaactttcatgatctcctttgtacctaaaactatctttgagatttcacacagggatcctagaaagttacaaggatcagttatttcactttatttaaaaaggatgctagataccgggtgtggtggctcatgtctgtaaacactttgggaggctgaggcaggcagatcacatgaagctaggagttctcgccaacatagtgaaactctgtctctactaaaaatacaaaaattaggctgggcgtggtggctcatgcctgtaatcccagcactttgggagtgagtccgaggcaggcggatcacctgaggtcaggagtttgagaccagcctggccaacatggtgaaactccgtctctactgaaaacacgaaaattagctgggcgtggtggtgtgtgcctgtagtcctagctccttgggaggcagaggtgagagaattgcttgaacctgggagatggaggctgcagtgagctgagatcatgccattgcactccaacctgggtgatagagtgagactccgtctcaaaaaaaaaaaaaaaaaaattaggccgggcatggtggctcatgcctgtaatcccagcactttgggaggccaaggcgggcagatcgcttgaggttagaagttcgagaccaacctgggcaacatggggaaaccccatttctactaaaaatacaaaaattattggtggcgggcgcctataatcccagctactcgggagactgaggcaggagaatctcttgaacccaggaggcagaggttgcagtgagccaagatcacgtcactgcactccagcctcggtgacagagtgagactctgtctcaaaaaaagaaaacaaacaaacaaacaaacaaaaaaagtgtatgctttatcggaagttcctggagatgtgtgcccttgcttttcataatatgttgcaacttagaggaaacactgaatgaaactgttatgaaatatttcctgggcagggcggtggctcatgcctgtaatcccagcactttgggaggccaaggcaggaggatcacttgagcccaggagttcaatacaagcctgggcaacacagtgagaccccgtctctactaaaaatttttttttaaaaagtaaacgggcatggtggcatgcacctatactctcagttactcaggatgctgaggtgggaggactgcttgagcctcgtaggtcatggctgcagtgagctgagattgtgccatggccacagagcaagaccctgtctcaaaaaaaagaaaaaaattattttcgttgagttttcctgtattcatcagagtcctggtggtgctttgcttgatgatattagacaacagcagtatagagtattattggtcataataattggttattattgtaaatgcttacttgctcacagccttctttaatttgaatctgacatcttctaggccagtgacgctcagtgcacatcagacttacccataaggttttattaaaatacagatgtttagattctactccaaactgactgaatctcgttattttatattcttggtatattatgcatgctacatctcaggattattatatactatatacaaatttttttttctatatactatatacaagtttttttttctggttggacgtggtggctgatgcctgtaatcccaacactttgggaggccaaggtgggcaatgacttgagcccatgagttcgagaccagcctgggcaacatggcaaaacccagtctctacaaaatagtacaaaaaattacctgggcatggtggcatgtgcctgtaatctcagctactggggaggctgaggtgggagagttgcttgagtccatgaggtcaagactgcagtaagctgtgattataccactgcactcaagcctgggcaacagggcaaaaccctgtctctaaaaaaaaaaaaaaaaagtaaaaataaagattttttcctctataagaatgtgttcatccatatttataaatgagaggtagcattcacaggtgtctttgaaaataaactttggccaggtgcagtggctcattacctataatcccagcactttgggaggctgaggcaggtggatcacctgaggtcaggagttgaagaccagcctggccaacatggtgaaaccctgtctctactaaaagtacaaaaattagctgggcgtggtggcgggtgcctgtagtcccagctacttgggagcctgaggcacaagaatcactcgaaccagagaggtagggttgcagtgggccgagagcgtgccactgcactccagcctgggagacagagtgagattctgtatcaaaaaaaaaaaaaaaaaaaaaaaaaaaacggcggggcatggcggctcatgcctgtaatcccagcactttaggaggctgaggcaggtggatcacttgaggtcaggagttcaagaccagcctggccaacatggcgaaaccccatctctaataaaaatacaaaaacattagccgggcctggtggcacgcacctgtagtcccagctactcgggaggctgagggagagaattccttgaacctgggaggcagaggttacagtgagccgagatcgtgctactgcactccagcctgggtggtagagcaagactccatctcaaaaaataaataaataaaaataaacttaatcattatctttagagacatttttgtctaaaaaaattattaggaacggcttaaaactgcaaacatttttatcttagtttctgtaggtgtgggatctgggtgcagctttgctattactaatagatagtcctggctcagggtctctcatgaagttgcgtctagggctacagtcatctgaaggcttgactggggctgggggtgtctgctcccaagaaggcccactcacctggctgatggctggtgttggctattggctggggtgcttcaggtctcctccatgtggcctctcagtctccagggcctcatttttttcatatagcctttctaattgatggctgggctccagtgagacagagagagggatctttttataaatgaatctcagaggtggtattatcatttctaccatattctatttgttttgagtcacaaaatccagaccacactcaaggcggggggcacagacaccaggatggggaatcatcagggaccacctcaaaggctgaccacagcattgcccctaaaatgtatggggccccagacaagtattttttgcaggaactctgtctatataaacaatttaaatacaaaatgtattacaagatcatgagtccatatgaggtattgggatttactgatgaagattttaatttatttattttagagatggggtcttgctctgtcacgcaagctggaatgcagtggcgtgatctcacctcactgcagcctcaaattcctgggctcaaatgatcttcccaccttggcctccagagtagctggaattataggcatgacgccactatgctcagctaattaaaaatttttgttgttgttggtggagatagtgtcttgcttttggagggtaaaggtttagaacaatgtgtcgacccattgtgaagtgaaataaatcaatcaataaataaaatagaacagtgtgtatgtctgggtgtggtgactcacccaactacttgggaggctgaggtggagcccagggttgagaaatgttcaaggctgcagtgagccatgatggcaccactgcacttcagcctgtctctaaaaagaaaaatttttaaatgaaataatgctatagctgtcataaatttgtaggtactaattaatagagtggcaagatgcaaaaagtataacctctgggaaatgtaataaataaatgatggaaatataccagaagcaggaggctttaacttacctttgtcagcaaatgacagctctagtagacaaaaacaaaaacagtataattaataaagctatatcaaattctcttttcttaaaaccatgaatacatcttttagtcagtcagcaactatggaacattagtaatcactggccataatattaggccacagagaaaagtttaataaattccaaaaagtagaatggatacagaccacattctttgaccataatgcaataaacataaacatggactttttcttttttctttccctttcttttttttttcttttcttttttttttgagacagagtcttgctctgtcacccaggctagagggcagtggtgtgatcatggttcactgcagcctctgcctcttgggctcaagtgattctcctacctcagcctcctgagtagctgggactacaggcgtgagccaccacacccagctaactttttgtatttttttgtagagacggagttttgccatgttgcccaggctggtcttgaactcctgagctcaagcaatcctcctgcttcggcctctcaaagtactgggattacaggtgtgagccaccaggtctggccaaacttggattttttaaaacaaaaataaaaccacaaaactccaatagctcagggaaaaaagatttagctctctcacgttttataatatccagtgctgtcaagagtatgaggaaaactgataatatataacaggtggcagtataaaattcagcaagcattttagaaaaagtttcacagtatttatcaaagttttacatttatatacattttgatccaggattttttttttttttggctaggaatttgctctttgtgtgtgtggtttttttttttgttttgtttttactttgtaaatttacttaaaaaaatagctgtctgcatatttttaatggatgagtaaaccaaaaatatataaacagctatttataaaggggtgaataaaaaaagataaaatagtttcttatgggtggagggagagggaagaaggttgaggagacagggatagaagctagatttatctaaatataccatattattattattattattattattttgagacggagtctcactgtgtcgcccaggctggagtgcagtggcacgatctcggctcactgcaacctccgccacccgggttcacgccattctcctgcctcagcttcccgagtagctggcactacaggctcccgccaccacacccggctaatttttttgtatttttagtagagacggggtttcaccgtgttagccaggatggtcttgatctcctaacctcgtgatccacacgccttggcctcccaaagtgctgggattacaggcgtgagccactgcgcctggcccatattattattatttatcttttgaatatactgtactattattgagaaccatgcaaacacagtatcattgtataatcattattatataaaattatgtattatttaaaaattgcatcatatcaaaaggaagttatagattactggggtcatatcaagcaagtttcaaaggctcccattggccaaagatggggcaatttgagcatcaaaaagaacaataactgcaatagattgaaatacatcacctagccctcagggcagaatgatgccacaaaatctccctggccacctttggaggatgctagtgaaccaactcattctgaaaactgataaataaagagagagacaaagtaactgactagataattgattaaagaattattatttttgagatatgatcatgatttactgctaacttgttaaaagctcttatcatttgggccgggcgcggtggctcacgcccgtaatcccagcactttgggaggctgaggcgggcggatcacaaggtcaagagatggagaccatcctggccaacatggtgtaaccccgactctactaaaaatacaaaaattagctgggcgtggtggtgtgcacctgtagtcccagctactcgggaggctgaagcaggagaattgcttgaacctgggagacggaggttgcagtgagccgagattgcaccactgcactccagcctggcaacagagcaagactctgtctcaaaaaaaaaaaacaaaaaaaggaaaagttcttatcatttacagcaacatcttgagagattcatgggtaaaatgatgtaatatctgggtgttgcttcaaaataatccagtggggatgtgggtagaggacataaaagaaacaacattggctgtgaattgataaatgttgaactaggtgatgactacatggagatttattgtattgttctctctacttttttatacgcttgaaattttccataacagaaaaataattttatggaggcaaaagctgtaaacagtgttctatgcctatattgagagtatgactcatgacttttttttaaaaaaagccagacctgaccttaaaaatttcttttattttaatttaattaaaaaaaatttttttagagacagcgtctcactttgtcgcccagactggagtgcactggtgtgctcatagctcattgtgcagctttgaactcctgggctcaagcgatccttccaccttagcttcttgagtagctgagactacaggcacgaaccaccacacccaactaatgtctttatattttatattattttattataattttattttactgtattttatttatttgtttgttttgagacagggtctttgctctgtcacccacgctggagtgcagtggcatgatctcagctcactggagccttgacttcctgggctcaagtgatcctcccacctcagtctcccaagtagctgggactacaggcatgcaccaccacacctggctaatttttaaaaaattttggtagcaatgggacctcaacatgttgcccaggctggtctcaaactcctggactcaagcaatcctccctcctcagcttcccaaaatgttgggattagaggcattgaaccactgcacctggcctattttatttttgaaaatagagacaggtggggggggtgggtgtctccctatattgctcaggctggtcccgaactcctggtctcaagtgatccttttggcttcccaaagtgctgggattacatgagccaccactcctggccactgtgctgggtttaattgtggagaactataactaagcattgtctttaaaaaacgagtacattggccgggcgcggtggctcacgcctgtaatctcagcactctgggaggcggaggcgggcggatcacgaggtcaggagatcgagaccatcctggctaacacggtgaaacccccatctctactaaaaatacaaaaaattagccgggcgtggtggcgggcacctgtagtcccagctactcgggaggctgaggcaggagaatggcgtgaacccaggaggcggagcttgcagtgagccgagatcgcaccactgcactccagcctgggcgacagagtgagactgcctcaaaaaaaaaaaaaaaaaaaaaagagtacattttgggccggttgcagtggctcacatctacaatcccagtactttgggaggccgaggcaggcggatcacctgaagtcagaagttggagaccagcctgggcaacacggcaaaaccccgtctctactaaaaaaacataaaaactagccaggcatgttggcgggcgtctgtaatcccagctactcgggaggctaaggcaggaaaattccttgaacctgggaggtggaggttgcagtgagcccggatcacgccactgcactccagcctgggagacagagggagactccatctcaaaaaaaaattaaaattaaattaaaataaaaaaagaacattttggcctacaattcctgacaaagatggaatgtgggcaaatgcatgatgacctggattatttctgggagaattgtaaagagtttctgtagtcagcagaaatgctttgaatactttccatatattagttcattaatcccccatgaagtacaagtaggggaaactgaggcacagggaagttgactaatttgcccagggtcacaaagtgagtaagtggcagaaccgctatttgaacctagctgcgctcatagtgctttaatcttcaatcagcgaggatcgtcaagttggctgctggatctttctggatctttttttcattacctcgcctttcatgttgtttgtccacatagcttgaggctttatcacagattgctcttgggggcagtgttactccagaaatgccggaatgctccgctattcctcactccacccctaaatatacagcatctcctcccgcccttaagctctgaaaaaaatgctgcggagccagaaaggctgcagaaagccgggtgtgaccactggctctgtagccaacctgttccctgctgctgctgctgctgctgctgctgctgctgctgcagtcgtttggtttcctctttgaatctgagatgattctgaggtctacactgcaaactcttggcatatatcatttctagaattccattcctactcgacctaggctgtgagtctgcactagttcgcggcacgttagatcgcgcccatttcccttattggcaagttgtcaggttgaggaagctccaggcctggaggagggcatctccagccaccagccatgaagcccagggcctcaggcaccttctggcctccgggtggcctcctctattcgctgacccagacactagtccagtggttcccaaagtggggttccctggcaggcagcagctgcctcgctgggaatctattaaaaatgcatactcccaggccccacccatgacccactgaatcagaagctgtgggcctggggcccagcagttggtgttttcagaagccctccagtggactccaatggttcctagagtttcaaaagcacactgggctaggccaggtgtgccaagagagaagtagctttttggctcaagtcctcacaggaatggtcagagggtccccatcagtctatcagtgtgcaccatacaacgctcacagagggacacacgtgtgcccgtgtgcatgcgtccctgtatggactccagttggagggggagggacagttttgccttgtggttttgtcactcgccattggaaaatagccctttcccctactactaaatagcttcccattgttttctagtccctttacttccatttcagagagtgttttctcttctgtgtttttttgtttgtttgttttttgagacggagtctcactctctcacccaggctggagtgcagtggcgcgatcctggcccattgcaacctccgcctccgggattcaagcaattctcctgcctcagcctgctaagtagctgggattacaagtgcctgctaccacactcacctaattttgtatttttaatagagataggggttttgccatgttggccaggttggtctcgaactcctgacctcagatgatccacctgcctcgacctcccaagtgctgggattacaggcatgagccaccatgctgggtccctcttctctttggaaaagtcatccacgttggttgcaagtttttcagaaaagagggaactacattatagaaataaatggcaaacagacacccaacacccaaggaataatttctcatctctgtcctttcaatgtgtatatttctaaatgtccgtgtttatatttacataaattaaaaaaaacggtttacttgtacgtgtcattttgtttttatcttaaatttttgtgtttttaattttggtgatatatcattttggttgtactttttcacttctgtacatactgttacataacatgcagttttccagtaacactaacttgtgaatgcatattttacaattttatttatatttatttatttatttacttttgagacagtctcactctgtctcccaggctggagtgcagtggcttgatctcggctccctgcaacctccacctcccaggttcaagcaattctcctgccttagcttcccgggtagctgggattacagacccgccaccgcgcctggctaatttttgtttttttaagtagagacggggttttaccatgttggccaggctggtctcaaactcctgatctcaggtgatctgcctgcctaggcctcccaaagtgctgggattacaggcgtgagccaccgcgcccggccccccctttttttttttttgagactgagtttccatcttgttgcccaggctggagtacaatgatgcgatctcagctcaccacaacctccgcgtcccgggttccaacgattctcctgcctcagcctccccagtagctgggattacaggcatgcaccaccacacccggctaattttgtattttcggtagagacggggtttctccatgttggtcaggctgatctcaaactcccaacctcaggtgatccgctcacctccacctcccaaattgctgggattacaggcatgagccaccgtgcctggcaggatagaagccattttaactggggtgagatggtatctcattgtagttttgatttgcatttctctgatgatcagtgacattgagcaccttttcctatgcctgcttgtcatttgtaggtcttcttttgagaaatgtctattgagatcttttgcccactttttgatcagattattagattttttcctctagggttgtttgagctctttatatattctggttattagtcccttgtcagatgggtagtttgcgaatattttctcccattctttgggttgtctcttcactttgtggattgtttcctttgctgtgcagaagttttttaacttgatgtgatcccatttgtccatttttgctttggttgcctgtgtttgccaaattcattttacaaggccagcattaccctaatgccaaagtcagacactacaagaacactacagccaatatccctgatgaacataaatgcaaaaagcctgcacgaaatactaacaaacaaaatccaacagcacattaaaaggatcatacatcatgaccaaatgggattaatccctaagatgcaaggatgggtcaacatacataaattaataaatgtgatataccacattaacagaatgaaggataacaatcatctcaaaagattcagaaagagtatttcacaaaaattcaatgccacttcatgataaaaactctaaactaggtatagatggaatttacctaagcataataaaggccatatatgcctggctaatttttgtatttttaatagagacggggattcaccacgttggccaggctggtcttgatctcctgacctcaaatgatcctcacctcggcctcccaaagtgttgggattacaggcgtgagccaccgcaccctgccacaattttcttctaagataaaaaagtttacataagggttctctgggatggaaacaaaagttggacagagccaggattattttaataaaatacaattaataggagttgtgataaatgaaatgatgccccacaaaagtgcccatgtcttaacccccacgttctaggaatatattatggtatatgacaaagaatagaggctgtagataaaatcaaggatgataatcagatgactctaaaacaaagagattaatttgaattatgagattggtgtctacagccataccaccctgaatgcacctgatcttatctgaattataagtgtgagcctagggtaatcacaaaagttcttaaatgggaatgagaggctaagaaaattaatgctgtgatatgagagtcagatttttttttaatttttttttaaattatgttgggctgggcacagtggctcacgcctataatcccagaactttgggaggccaaggcgggcggatcacctgaggtcaggagttcgagacaagcctggccaacatggtgaaaccccatctctactaaaaatataaaaattagccaggcatggtggcaggtgcctgtaatcccagattcttgggaggctgaggtaagggaattgcttgaacctatgaggcagaggttacagtgagccgagatcacaccattgcactccagcctgggggacaagagtaaaactccgtcacaaaaaaaaaaaaaaaaaaagtatgtatacacggccaggcacggtggctcacgcctgtaatcccagcactttgggaggccaaggtgggtggttcacttgaggtcaagagttggagaccagcctagccaacacggtgaaaccttgtctctactaaaaatacaaaaattagccaggcatggtggtgcacacctttagtcccagctactagggaggttgaggtaagagaattgcttgaatccgggaggtggaggttgcagtgagccgagatcatgccactgcactccagcctgggcgacagagagactccatctcaaaaaaagaaaaaaaaaatatatatatatacacacacacacacacacaattattcttagaatatatatatatatatatatatacatatatatatatatatatactaggtatatagtgtaaaaataatgctgactgtacttttgaaaatttatgtaatagaattaatcaagaattttatgagataaaaaagtgatgattttgaacatacaataaataacatttatgaggtaaagtctattttttttttttgagacagagtcttgctctgttgcccaggctggagtgcagtggcgcgatcttggctcactgcaagctccacctcccgggttcatgccattctcctgcctcagcctcccaagtaactgggactacaggtgcctgccaccacgcccagctaattttttgtgtttttagtagagatgaggtttcaccgtgttagccaggatggtctccatctcctaacctcgtgatccgcccaccttggcctcccaaagtgctgggattacaggcgtgagccaccacgccgggtgtaaagtctattattttcagatattcaaaatatgtttctcttttgcaatttacattattacattccacttatgttttcattgaaaaatgcctctttttttcaagctggcattggaatcttgaccctcagcttcctcattttcttcctcgtcttcacacttcttctgtaatgcaggcctgagcccacagacctgaccatttatcacctggtcttcatccacatagtgatcctccttactctggtgtcattgttgtctccaggtctgcctgagtcactgtattttcagaatgacttcaagtgtaaaggattttttttacctgaacaagatgatgagaagtttctccatctgcaccacctgcttcctgagtgtgcttcagaccataatcatcagccccagaagctcttggttggtgaggtttaaccataaatccaccattttcacctgtcatttcttgttgtttttacattttctcagtttttttttttttcagtagtaatctcatcttgtgcactgtggggtcttctaatgtgaccctgagcaatcttctgcataccagtaaagactgttcacttttccaccatgaactccatcatcagaagactgtttcttactctgtttcttactccagatatgtttttcttataggaacaatgctgctttcaagtgcatacagagtggtccttttgttcaggcaccagaagaaattctgatactttcacagcaccagcctctccccaagaccttccccagagaaaagtgccactcagaccatcctgctgctagtgagtttctttgtggtcatctactgggtcgatttcatcatctcatgcacctcaacctcgctatgggcatatgaccctgttgtcctgggtgtccagaggcttgtcagtcttttggtgctactcagatctgataaaaggataatcattgtgacacaaactgtgagacagagggttaacaagttatttttattgaaaatagattattctgtcaccagttaaattacataagtagtacagaacttgctatttaatttaacttaaatgtatggatttacactttcaatatgtctaaatacttttgaatcaaatgctgccaattctctgtgggttttttttagtttaacatacatgatggatagatactcccatatgtttacaagtgtcttctttttcattttgattttcaggccttaatacagagaacatttttctttctttttgaagtataatattaagaatatcctcctggtaatataatctctctgtcttcgtatttttgagaatgttttatttttatttattaaagatatttgactaaatattaaattcttacactcaatatttacttctccttgttctggcttctatcaaggctgtgtggatggtgcctacaaatttgtggcttacctctgttttttatctccctaattttaagatttttctttctttttagtgttatacagcttgactattatttctgtataaatgatcacctgtatttaccttttttttgaaaactatgtacttctgaattcgagaattttttctggcttttaattttacaaaaaattatttctttctaaaattacatttgtgtcttattctttgtatgtatttcagtgaaacaactgaatatactttattccttctaatctttgtctttatagatctataaatatatttacatcttatatcactttacttttattagcatcgattttctctccttaatcttccagtgcactatttatctcattagcttattctaagttaatagtttcccaatacaatgtatattgaatttatagatttttatttctcatttattcaatttacagttagctctttccatggatgctcttcaatttttaagtttcttcctctttaaacactatttttgtctcttattttatcactgaattgatgtaaacattttaaatacaattccaattattattaatttatgtagcatccaatttcttcttactctaaattgtggtagcttattttgtgtgtgtgtgtacttcataacttcttataatttagctgtcatgattgggagacctttccctgtaaatgtcttcaatcagtatatttgtttgttctacttaacctggcacaatattatcaattttgccttgtgatcagccattcgcttctcacgttgataaagcctttgaatcttttcttgactcatttgtgttcctggaaagttctgatatttttcctttcagccccattgggcattctagagatttttgtaacttttgatgcacaaactttcacactgcacacataaaatattttagttatgtaatgctaccacacatcagcatcttatgagaaatcttgagtctctttacttgaagcaccccctctccaatatacagtatgatacactgatgtgcagaatgtgattagtttattaatcatatgtgaaaatattagtagctacatatggccagaatagatttttctctctacaaatgtaagttagtgttgatagaatttgttatgcgatatttggttctttggtttcagtctcaatgctttcttcttggcatttcattgactctgtaaattaacctcagcatcaattttcttttaaattcaacagttattcaaattgatcgaaaattaaacttgtatgtagctagttatcacttgtgggttacactttaattgacggtttctgatgtcatttcatagtgtctagaatataggacctattggagatctactttcatgaaattactgacataattttgggtccaaaatttcaaaattttaaatatttttatttggaattttaaaataatttatatgctctttttactggctaataatgctattcattataatctgatattcaaactgtctaaaaaagttaacaatcattgatttatttgttgtatatacagtttatttctatgacagttttaatgtcacctaatattatttttaatgtttcaatttctcatttaaatacattttgtgttgtttattttaatctcattcaatctgtatgtgcaaatggcttagaaaaaaaggccatatatgacaagcccacagctaacatcatatagtcaacagtgaaaaactaaaagcttctcctttaagatcaggaacaaggcaaggatgcccattctcaccactcctattcaacatagtactagaagtcctagccagagcaattaggcacgaaaaagaaataaaaggcagctgggcgcggtggctcacacctgtaatcccagcactttgggaggccaaggcaggcggatcacgatgtcaggagatcgagaccatcctggctaacatggtgaaaccctgactctactaaaaatacaaaagattagccgggcgtggtggcgggagcctgtagtcccagctactcgggaggctggggcgggagaatggcgtgaacccaggaggcggagcttgcagtgagccgagatcatgccactgcactccagcctgggtgactccagactccatctcaataaataaataaataaataaataaaaaagaaaaaaaaagaaataaaaggcaacaggccaagtgcagtggctcacgcctataatcccagcactttgggaggctgaggcaggctgatcacttgaggtcaggagttccaagaccagcctggtcaacatgatgaaaccccgtctctactaaaaatacaaaaacttagccaggcgtggtgccacacgcctatagacccagctactcaggaggctgaggtgagagaattgcttgaacccgggaggcagagggtgcaactccagcctgggcaacagagcgagacttcatctcctaaataaataaataaataaataaataaataaatggcaaccaaatcagaaagaaaaaaaactacctgtttacagatgatagaatcttatatctagaaaactctaaacactccacaaaataactgtgagaactaataaacaaattcagtaaagttgcaggatacaaaatcaacattaaaaaatcagttgtgccgggcacggtggctcacacctgtaatcccagcactttgggagacagaggtgggtggatcacctgaggtcaggagctcgagaccagcctggaccatatggcgaaaccccgtctctactaaaaatataaaatattagctgggcttggtgctgagtgcctgtaatcccagctcctcaggaggctgagccaggagaatcgcttgaacccgggaggtggaggttgcagtgagccgagattgcaccattgcactccagcctgggcaacaagagtgaaactctgtctcgaaaaaaaaagtcagttgcatttctatacactaacaatgaactatctggaagggaaattaagaaaataattccatttacaatagcatcaaaaagaataaaatacttaggaataaatttaaccagacgtgaaagacatgtacactgaaaactatgtaacattaattaaagaaattgaagacaataccaatgaacagaaagacatcctgggcttgtggattgttagacttaatatagttaaaacgtctatactacccaaagcagtctacagattcaatgcaatccctgtcaaaatctcaatgacattttctacagaaatagaaaaaaatccaaaaatccatatggaactacaaaaggcctcacagccaaaacaatcttgagaaagaagaacaaaagagtcatcacactttctgatttcaaaatctattacaaggcttcagtaattaaaacagtatgctactggcataaaaacagacagacatagaaaccaatgaaacagaatcaagagcccagaaataaacctcacatatatggccaactaatctttgacaaaggtgctctgaatacacaagaggaaaaggataatctcttcaacaaatggtataggaaaaatttgatatccacatgcaaaataatgaaatggacccttatcttacactacacacaaaaataatttggaatttattttaattattccattattttaataaagaaatttatttttaaataaatgtaaataaatacattttattttattttattatttatttatttttttgagacagattctcactctgtcgcctaggctggaatgcaatggcgtgatcccggctcactgcaacctctgcctcccaggttcaagcgattctcctgcctcagcctcccgagtagctgggattacaggcatgcgccaccacgcctggctaattttttgtatttttagtagagacagggtttctccatgttggtcaggctggtctcgaactaccgaccttaggtaatcctcccacctcggcctccgaaagtgctgggattacaggcgtgagccactgcgcccggcctacatttatttttaaataaatggatttaaatgttaagacctgaacctataaaaatgggacacctgcatagggcattaaccatgagtagagcttgcaggactggaagttgctatgggtgagtcagtgtgtgagtggtgagtgaatgggaaggcctaggacattcctgtacactaccatggactttataaattctgtacacttaggctacactacatttatttaaaatatttttcttttttgggccaggtgaggtggctcacgcctgtaatcccagcgctttgggaggccgaggcaggcggatcacctgaggtcaggagttcgagaccagcctgaccaacatggagaatccctgtctctactaaaaatacaaaattagctgagtgaggtgacacatacctgtaatcccaactacttgggaggctgaggcaggagagtcgcttgaacctaggaggcagaggttgtggtgagctgagatcacaccattgcactccagcctgggcaacaagagtgaaacttcgtttcaaaaaaaaaaaaattcttcctattttttttttttttttttttgagacagaatctcactctgtctcccaggctggagtgaggtggcacgatctgggctcactgcaaccttcgcctccagggttcaagcgattctcctgcctcagcctcctgagtagctgggattacaggcacccgacaccatgtctggctaatgtttgtatttttagtagagacggggtttcaccatgttggccaggctggtctctaactcgtgacctcaagcgatccgtccgcttcggcctcccaaagcgctgggattacaggtgtgagccactgcacccggctcatttaaaatatttttcttggctgactctgggcacactacctatgagttagccctgcttctcaaggagcagtaccattcaaaaaattaaaattaaaaaaagagagaaaaagaaatttaaaaaattttctttcttcgataataaattaacctttgtttactgtaactttatggactttttagtttttaaaaaacttttttactcttttgtaataacacttggtctaaaattaaagacattgtatagttgtacaaaaatattttctttctttatatccttattgtataagttttttctatttttaaaaatattttacatattgcttgagcccaggagtttgagaccagcctgggcaacatggtgaaaccccatccctacaaaaaattcgctgggcatggtggtgcacacctgtagtcccagctactagggagactgaggtgggaggactgcttgagccggggagattgaggctacagtgagctgagattgcaccactgcactccagcctgggtgaaagagtgataccctgtcttcactctctctctctctctctctctctctctctctctctatatatatatatatatatatatagctatatatctagtatatatatatgctatatataggtatgctatatatagtatatatgctatatagaggcatgctatatatagtatatatatgctatatagagatatgctatatatagtatatatatgctatatatagtatatatatgctatatagagatatgctatatatatagtatatatatgctatagagagataaatatatatatactatatatatattttaacattttgaactttttagttaaaactgagacaaacacacacgttagcctaggcctacacagggtcaggatcatcaacatcactgtcttccacctctgtatcttttcccactggaaggtcttcaggagcaatgacaggcatggagctgtcatctcctgtaacaatgccttcttctagaatgttttctgaagatctgcctaagggtgttttacagttaacctttttgtgtacataagagtacactctaaaataatgattaaaactatggcatagtaaacacataaaccagtaacagttgtttattatcatcaaatattatgtactatacataactgtatatgtgattcagtatttttattttattttattctattctattctactcttattttattattttattggaaacaaggtctcactctatcgacagactggagtgcagtggcccaatcctagctcactgaagcctcaatctcctgggctcaagtgatcctcccacctcagcctcctgagttgctgggattacagatgcctgccaccgtgcctcgctacagtacttttataggactggcagcacagaaggtttacaccagcatcaccacaaacacgtgagtaatgtgttgtgctatggttagatgataggaattttttttttttgagacagagtctcactctgttgcccaggctagagtgcagtggtgcaatcttggctcaccgcaacctctgcctcctgggttcaagcgattctccctgcctcagcctcctgagtagctgggattaaaggcatgtgccaccacagtcgggtaatttttgtatttttagtagagatggggtttcgctatgttggccaggctggttttgaactcctgacctcaagtcatccacccaccttggcctcccaaagtgctgggattataggcgtgagcctataatctggccagatgataggaatttttcaactgtattataatcttatgggacaactgtcatatatgtggtctgtcattgacagaaacatcatcacttgttgtatgactatggcatgattccacttatatggggtatccagagtagtcaaactcatagaaacaaaacactaggatggtggttgccaggggctgagaggatggggaaatggggagttgctgttcaatggatattgcgcccggccagccacaccaattcttacaccaagaagtgatggagcacaagtgctgatgggccttaacaccatcataaacatcttttgtttgtcccggggaagaaattcccaactccttccaaaggtctgccaaagtctaccagtatcccaagctgatttccttatcccctcagcagatgctggaaagctggaagtctccttccttctcactctcctgcttgacatctgcacagccattcttcttcctccccttgctccccttcctccccttctccttctcctacttattgagacagagtctcgctctgtcgccgaggctggagtgcagtggtgtcatctcggctcactgcaacctctgcctcctgggttcaagcaattctcttgcctccacctcctgagtaggtgggattacaggtgtgtgccaccacagcaggctaatttttgtatttttagtagagacggggtttcaccatattggccaggatggtctcgaactcctgacctcaggtgatctgcctgtcttggcctcccaaagtgccgggattacaggcatgagccaccggcgcccggccctttttattattatatattatttttgagactgggtctcactctgtaatccaggctggagggcagtggcgtgatcacagctcactgcagccctgacctcttgggcacaagcagtcctcccgcgtcagccacccaaagtgctgggtctacaggcatgagctactgtgcccagtctacgatttttttaaaatttataattattttgtttattcaggcagtacaacatgatgttttgatttatgtacacattatagagagtcaagctaattaacacacccaatacctcaccaatttatcatttttgtgtggtgagaacgttaaaaatccattctttctcctctgaagctgtagaggatggggtgtccctgctttcctttttaacgataaaatcatgtttgttatttcataaaatagttagacagtgaggctttgttagtttgtttaatgtcctaactcggcaaaattgaaaggtggcaacactctgcccctctcccatgcaccatgcatacacacatatgtttacagctaggttttttttggggggggaggtagtatccatatcatgtattaattttcttacaatttattttttcttttctttcagtgacggggtgttgctctgtcacccaggctggcgtgcagtggtgtgatcatagctcactacagccttgacctcccggcctccagctatcctcccatctcaggctcccaagtagctgggaatacagacatgcaccaccacacccagctaatttttctttttctttttcttttttcgtaaagacaggatttcgccatgttcgccaggctggtctcgaactcctagcctcaagccatcctcccaacttggcctccaaaagtgctgggattataggcaatgagccaccatgccctgcctaattttcttacaatttcaaaatataaatatcatatcttaataatttataatgacgtcaccaatattctccctattgtctcaaaaaagtggcaacctttgcagaagggaggatcttctaaaagaacaaaatgaaaaaagataagaattctaacttgggtcttgcgccgggcattgcctgaagcagacagccagaggcaatctttcaggaatggagtgaggaagaaatggggagggagaggtaagcctgggggttctgtgggcagcaggaatcttcagctgctgggaggtaaggggacttctaagaaagtggatgtcctctgtttgactttgttatattttctgctgtgtggcccgggcttgtcagcttgtcatctttctcccttggccctataaacacagagaaacagagaaaagaacaagaattctggggacagtggaattagaaccagaggtgaccaaagggacatattatccaggtggtaactgccggaagtagatgttctttaacagtttaaaaagtgatgatgaggccaggcacagtagctcgcgcctctaaccccagcactttgggaggccgaggtgggtggatcacctgaggtcaggagttcaagaccagcctggccagcatggtgaaaccctgtctctactaaaaatacaaaaaattagccaggcatggtggcatgtgcctgtaattccagctacttggaaggctgaggcaggagaatcacttgaacctgggaggcagaggttgcagtgagccgagatcgcaccactgcactccagcctgggcaacagagtgagactccgtctcaagaaaaaaaaagtgatgatgatgatgacagaaagaatacaatgtagaaaagcttagacccttggctaatggggctttgtttaaccacataggatttaatcccaaccacttctgccaaaattttgttctctagaggccctattctttgctttctttattattattattattattattattatattattttttttagagttgaggagtctggttctgtcacccaggctggagtgcagtggtgtgatcttggctcactgcaacctctgcctcccaggttcaagcaattctcctgcctcagcctcctgagtagctgagattacaggcgtgtgccaccacgactggctgatttttgtatatttatttatttatttatttattttctgagaccgagtcttgctttgttgtccaggctggagtgcagtggtgcgatcttggctcactgcaacctctgcctcccaggttcaagcaattctcctgcctcagcctcccaagtagctgggattacaggcacccaccaccgtgcctggctaatttttgtatttttagtagagacggggttttaccatgttggccaggctggtcttgaactcctgacctcaggtgatccacccacctcggcctcccgaagtgctgggattacagatgtgagcctctgcgcccggccaatttttgtatttttagtagagacggggtttcacactgtttttcccaaagtgctaggattacaggtgtgagccacctcacctggccccattcttttgctttctaccctttcttaaccctgttcccaaaatgtatgcgtctgtggctggaatatgttaaagggaagtagctttccacctctgtattggttcattctgactctgctttttcttgcacctgtgctcttctttttaaaatgtttttgagtgtttttatttaacactaatacacattgggtttggccaaatagatgtcttttcatccctgtgcccctctgcaatgatacatttctggagaggagaggccaggcaggtttcattatccttacacattacctggcaagctgccatgtgcaacaggtatttaatacatattttttgaaaaacaatctctcatgtctttggaatcattgggaactacaaccaagtgaaggcagtagaagttggtggctgatgaagtgcctacaatgcatgctatttctatagggaagattccaaacgtacgtcaattgttagtaaaggaattgatagaggccaggcatggtggctcatgcctgtaatcccagcactttgggaggccggggcaggcgaattgcttgagcccaggggttcaagatgtagcctgggcaacattgtgagattccgtctctactaaaaatacaaaaattagccacatgtggtggctcacacctgtagtctcagctacttgggaggctgaagtggaaggatcgcctgattccaggagttcaagaccacgctgggcaacatagggagacctcgtcactaccaaaaataaaaaaaattatctgggcgtggtggctcatgcctgtggtcccagctacttaggaggctgaggtgggaggattgcctgagccaaggaggtcgaggctgcagtgagctgagatcatgccactgcactccagcctgggtgacagaatgaaagcctgtcccccaaaaaataaaataatgaaatcatgagctaaaccaagtacaaaattaataaataaaaagattaaaaataaaaataaaataaaggaatggatagaagggatgaattgtcaacaagatcccgatatgttttcccttctgatttcaagtatctaattcagttattcattttaccctgagggtggcagcaggagtctcttctatcgcccaagcgttgccaagaggcaacttttaggtcactctgacatgagctaacagatgcagtttctggttagagagcttggacagatccatgccatttcctctcccttacaaggttggggggaaaggctgcgtgcggcctcaggaaaccctggggagcagcagggatcctccccagctgtcgcccaattagaaagccagtgatttaacagaaggccaagaagactcacagggccaggcctggggttctctttgttccaccttttttcccatgctgagaaatgaaagagaaaaacattgcatgacaagaattaatggtgtcaaacaaatagcatcaaagacaatttaagtattgctcttctctctcggaaatggatgaagacaaagagtagtggcttcctttttacccattaactgctctacatttggaaagagctggtggacagtgttttcatactgtatccattcagcttgatgcttacaaatgtacagttcagaaatttttcaaggaaacagtttgctacaaagcacatagtttcctctgatcataaccatgacctcgtttataatcataatcttgtttataatctcaggatgccaacatgcccaaaatgactttggaatcattgttttaaaatttcatctttttttaagactttattttttagagcagttttaggttcatggcaaaattgagcagaaagtgcagaaatttcccagataactcctgcccctacacacccacaacctctgtcactatcaccacccctaaccagagctgtacagttgttgcaattgatgaacctgcaattgacgcatcatcatcacccaaagtccatagtttacattatgactcactcgtgttgtatattttatgggttttgacaaagatacaaggacacatatccatcattgcagtatcatgcagagtagtttcactgccctaaaaatcctctgtgctccacttattcatctctccttcccctcaactcctgtaaaccactaatctttttactgcctccttagttttgccttttccggaatgtcatatagttggaatcatacagtatgtagccttttcagattggcttctttcacttagtatatcagtctgttctcatgctgcttataaagacatacccaagactgggtaatttataaagaggtttaacggagtcacagttccacgtggctggggaggcctcacaataatggtggaaggtaaaaggcatgttttacatggtggcagataaaagagaatgtggaccaagcaaaagggttttccccttatgaaaccatcagattttgtgagacttattcactaccatgagaacaatatgagggaaactgccccccatgattcagttatctcccactgggtctctcccacaacgcgtgggaattatgggagctataattcaagatgagatttgggtggggacacagccaaacctatcacttagtaatatgcatttaagtttcctccatttttttttttttttctgagacagagtctcgctctgtcacccaggctggagtgcagtggcgcgatctcggctctctgcaacctccgcctcccgggttcaagtgattctcctgcctcagcttcctgagtagctgggattacaggcgtgtgccaccacgcccagctcatttttagtagagatggggtttcaccatgttggccaggctggtctcaaactcctgacctcaagtgatccacctgcctccgcttcccaaagtgctaggattacaggcatgagccaccgcgcctggcctcttccatgtctttttatggcttggtagctcagttctttttctcactgcataatattccactatctggatgtaccagtttatttatccactcacctaccaaaggacattttggttgcttccatgtttttgcaattatgaataaagctgctataaacattcctgtgtgtagatttacgtggggacataagttttcaagtcatttgggtaaatatcaaggaatgcaattactggatggtatagtaagagtatgtttagttttgtaagaagccgccaaactgtcttccaaagtggctgtgccattttgcattctcatgaatgagagtttctgttgctccacatcctcgacagcatttggtgttgtcagtgtgttgttttcaccattctaataggtgtgtagtggcatctcactgttgttttattttattttttatttttttaattttgagacagggtttcactctcgttgcccaggctggagtgcaatggcgcgatcttgactcaccgcaacttccgcctcccaggttcaagcaattctcctgcctcagcctccctagtagctgggattacaggcatgtgccaccacgcccagctaattttgtatttttagtagagacggggtttctccatgttggtcaggctggtcttgaactcctgacctcaggtgatccgcccgccttggtctcccaaagtgctgggatgacaggcatgagccactgcgcccagcctaactgttgttttaatttgcaagtctctaatgacatatgatgttgggcatcttcatatgcttatttgccatctgtccaccttctttggtgaggtgtctattcaggtcttttgcccattttttaatcaggttgttcattttcttaccgttgagttttaagagctctttgcaattttggataatagtcatttatcagacacctcttttgcaaatattgtggcttgtcatttcattcacgtttgtggggaggggggaacggagtctcactctgtcacccaggctggagtgcagtggtgcaatctcggctcactgcaacctctgcctcctgggttcaagcaattctcctgcctcaacctccaagtagctgggattacaggtgcacactaccacacctggctatcatctcattctcttgatcatccttttttcttaaattaaaaagtgagcaatttctttgcagtcagaacaacatttctgttggcagtgtgtggtggtaaagagggggactctggagttagcttggatttgaattccagttctgccacttattagctgtgccagttactgaatgtctctgtgctgcactttcctcatctttaaaatgggtatatgagctgggcgtggtggctcatgcctgtaatcccagcactctgagaggcagaggtgggtggattgcttgaggtcaggagttcaagaccagcctgggcaacacggcaaaatcccgtctctacaaaaaatacaaaaattagctgagtgtggtggtgcacacctgtagtctcagctacttgggggactgaggtgggaagatcgcttgggcccaggaggaggaggctgcagtgagtggagatcgtgccattgcactccagcctgggcgagagagtgagactctgtctccaaattaaataaaacaagatggagataaacccgtactcatagggttgctgtgaaaattaggtcaattaatataattagtataagagatttaaaacagtttctgcaatatttattattaaattatttgattagaacaaaagatatagtttgcacagtggcagagacatgcatgaaaagcaatggtagacatttctgacatgaagggcatgccttggcagccttttaagatcattctccactgagcagcagcagtttcgttttagaagtcacatcaaagctactttggcttttgcaaggcgatttctgtgcattatgcacagaatgacataccaacctaagaaaattgatctactagcaattagtgagatggagcaggagaaggagctagcttgctatggaaaaagtgacaaagagatggactgagttgagacacttagaggtctctgacactaactggctgcctcactttgtacaaatcactttattcatctgtttcaggcttccacttggttttgttttgttttttgagataagagtcttgctctgtcatccaggctggagtgcaatggcgtgatctcggctcactgcaatctctgcctcctgggttcaaacgattctcctgcctcagcctcctgagtagctggaattacaggcatgcaccaccaggcccagctaattttttttttttttttagtagagatggggtttcaccatgttggccaggatggtctcgaactcctgacctaaggtgatcagcctgcctgggactcccaaagtgctgggattacaggcgtgagctaccacgcccggcccaggtttccacttttgttatgaaggtgttacagttatcagggctggggatggatatgcacattaatcgtgttttttaattttctgtatttcatgatgctttgacatcttggggccttgctaatcttggagagactgtccctcccagggctaactaattcctacagaacttgactctgagcatgcttttgatatgcaaaccaacaatcatgagaccatacccaaaccacctcctttttctaactctcacacaccagccaatattccccctccagggccaggtactgaacaactaggggccaccctgtagcccaccaaaatcattcaaactatccagtcctaaggtttctcagcttgccaatcctgtctcatccattccttcccataaaacctacaataaaggctctgggcccatgctttctcctcactcctgactcctgactgaccctggtgcctcccatgtggcccttgcatggccatggcttggcaagccccctcctcttgagaactgtgagtaacaaactatcttttcaatggcagttgccttgtgatctgctgggctcaccatacctcaatttttaaagattcttggttatattttaaaacaatctaaccccaggtgctaactctggtggctgcttaatagctgtcccaagtgagggatgagaaaaatcttcaggttgagtcaaaatatcaatgtctgccctgagcatgggttgtgaggaataaagatgtgagagaaagggtttgtcctccctgacacagatgatctctaggggcccttgcagctctaatatctaagcattttagaaagtattttaaggccaggcacagtagctcatgcctataatcccagcaccttgggaggctgaggtgggcagatcacttgaggtcgggagttcgagaccagcctgggcaacatggcaaaacccccatctctactaaaaatacaaaaattagccaggcatggtgccacatgcctgtaatcccagctactcgggtggctgaggcaggagaatctcttgaacccaggaggtggaggctgcagtgaactgagatcacaccactgcactccagcctgggcaacaaagcaagactctgtctcaaaaaaaaaaaaaaaagaaagaaaggaagaagaggaacaggagggaggaggagggatctgagctagcacgctcagccccttgccaagtgataccctgcactgtctcaggactcttcagagtcctcaccagcaaaaagtcccccaccagatgcagccccttgaccttagacttctcagcccccacaactgtaagaaagaaattcatttcctttaaaattacccagtttcaggtattctgttataagcaacagaaactggactaagacaggaaaacacaaacattcagtccattgccttccaacacctgcctgcccccgacaattcatgtgcttctcacatgcaaactacattcaattccatccaaacatccccccaaatcttaactcattccagtatgaactctaaagtctaaagccaaaagtctcatctaaagatcatctaaatcaggtatgggtgaaactcaccctgaagcaaaattcctcttcagctgcttaaaagaaaccaaagtatttgcttccaaaatacaatgatgggacacaaagagggtctataaacattcccattccaaaagggagaaacagggaaggaggacggggtgacaagtcccaagcaagtccaaaacctagcaagggaagttctgtgagatcttgagactcaggtaatcctctttggcttgaagctttgcctccagacctactggggtgtcagtccctcatgccagacccactgagggggcaatgtcaccctcacagtgagagacaggactagctggatttcctaggctgactaagaatccctaagcctaggtgggaaggtgaccgcaatccacctttaaacacggggcttgcaacttagctcacacccgaccaatcagggagtaaagagagctcactaaaatgctaattaggcaaaaacaggaggtaaagaaatagctaatcatctatcacctgagagcacagcgggagggacaatgatagggatataaacccaggcattcgagcccgcaacggctaccctctttgggtctcctccctttgtatgggagctctgttttcactctattaaatcttgcagctgcactctcttctggtccgtgtttgttacggctcgagctgagctttcacttgcagtccaccactgctgtttgccgccgtcgcagacccgccattgacttccatccctccagatccggcagggtgtccgctgtgctcctgatccagcaagccgtccactgctgctcccgatcgggctaaaggcttgccattgttcctgcatggctaagtgcctgtgtttgtcctaatcgagctgaacactagtcactgggttccacggttctcttccgtgacccacggcttttaatagagctataacactcacgcatggcccaagactccattccttggaatccgtgaggccaagaaccccaggtcagagaacccgaggcttgccaccatcttggaagcagcccaccaccatcttgggagctctggaagcaaggacccccaccccccggcccggtaacaacagtttggcagcactcactgctcatgctgtggttgtcagggcaggagttgtagcctcagggctctgctgggagcctccatccccaccgctctactgggcattggtctcaccctttgaaatggaggtggaggctgggagtggtggctcacacctgtaatcccagcactttgggaggccaggacaggccagtcacaaggtcaggagatcgagaccatcctggctaacagggtgaaaccccgtctctactaaaaatacaaaaaattagctgggcgtggtggtgggcgcctgtagtcccagctacttgggaggctgaggtgggagaatggcatgaacctgggaggcggagtttgcagtgagccaagattgtgccactgcactccagcctggatgacagagcgagactctgtctcaaaaaaaaaaaaaaaaaagaaatggaggtgcaggtagtcctatgccctaagcccatgtactctgggcctctgatgggactggtgacctggacggtctctgaatcaccttcagggttcttcttcccttatcttgaagaacagtgtgtgttcacagccgaatagttctatggtttggtcctataggatctaagaagtttaatcatcttccttcattttgtcccattttctttttttctttttcttttttttttttgagacagagtctccctctgttgcccagcacccaggctggagtgcagtggtgcaatctcagctcactgcaacctccgcctcctgggttcaagtgattctcctgcctcagcctcccaagtagctgggattacaggcgtgcaccaccgcacccggctaatttttgtattttcagtagagacagggtttcaccatgttggtgaggctggtcttgaactcctgatctcaggtgatccacccgcctcagcatcccaaagtgttgggattacaggcatgagccactgtgcccagccattttgtcccattttctctgtttcctttagtcccagtcagcagtgccatttccagtacaatcccatcgctattgctgttttgttgagatggttaatgaagtccacagttcacattcacagtaatctccttgtcaaatagtccagcagatccttagtgttctcttccaaacatgctttgtcatgttttgtaatatggacagggacaggctgagaattttccagacccactgagggagcaatgtcaccctcatagcttgggtaagtttaagttctggttcctttttgcataacaattctgttttcaattcatatctctcttctcaaatttgactataagcagtcaggaggaaccaagcctctcctttcaacactttgcttagagatctcctcagctaaatctccatttcactgttcacaagtcctaccctctacaaaacactaaaacgtaaacacaattcagccaggttctttgctactttataacaaggatcaccttttctccactgtccaataacacgttcctcatttctacctgagaccacatcagaacagcctttaaccacccatatttctaccaccaatctgttcatgattacttatgtattctttaagaaagcagaagctttctctacagctctcctcatttctttctgactgctcatcagaatcacctttaaaggtccattcaatggcaatataggatttttctttttttcctttttcttttttttagatggagtcttgctctgttgcccaggctggagtgcagtggcgcaatcttggctcactgcaacctccacctccctggttcaagcaattctcctgcctcagcctcctgagtagctgagattacaggtgtgcgccaccacgcccggctaatttttttttttttttttgtatttttagtggagatggggtttcaccgtggtggtcaagttggtctcaaactcctgacctcataatccatccacctcggcctcccaaagtgctgggattacaggtgtgagccaccgcacctggtggcaatataggatttttctagcgcatgcacccaaatttatgtcttagtctgttttctgttgctataacagaataccacagaccaggtaatttataaagaaaagaagctcagccaggtgcagtggctcacacctataatcccagcactttgggaggccaaggtgggtggatcacttgaggtcaggagtttgagaccagcctgactaacatggtgaaacaccatctctactaaaaatacaaaaattagctgggcctggtgatgaatgcgtgtaatcccagctagtcgggaggctgaggcaggagtattgcttgaacctgggaggcagaggttgcagtgagcagagatcgtgccactgcactccagcctgggtgacagagtgagattctgtctcaaaaaaataaaaaataaaaataattttaaaaagaagcttaacaagctcacagttctggaggctgggaagtctaagagcatggtgctagcatcagatgaggccttcatgctgcatcatcccatcatgggtagacagaatggcaagagggtgcatgcgagagacagctcacttttataacaaagccactcccacaataacagcattagtccattcatgaaggtgacagccccatgacctaatgtcttcttaaagaccccacctctcaatactgttacaatggcaattaaaggtcaacatgagttttggagggaacattcaaaccatggcactcttccagcctctagtcattacaattacaaggccacttccacatttttaggtattcgttacatagcacccctcacttctcagtaccaatttctgtcttagtcagttctgactggtataacaaagtgccatagactgggtggcttataaacaacagaaatttctctcttaacagttctggttggaagtctgacattacggttccagcatggtcaggttctggtagggatgctgtttagggttgctgacagctaaattttcattgtatcctcacattgtggaaagaactctctggggtcccttttatttatttatttatgtatttatatttttctgagacagagtctcactctgtcgtccaggctggactgcagtggcaccatctccattcactgcaacctccgcctcctgggttcaagcgattctcctgcctcagcctcctgagtagctgggattacaggcaaacaccactatgcccagctaatttttgtatttttagtagagacagggtttcgccatgttggccaggctggtcttgaacttctggcctcaggtgatccacctgcttcggcctcccacagtgctgggattacaggcgtgtgccactgcgcccagcctggggtccctttcataagggcaccaatcccattcatgagggctccactgtcatgacttaatcacctcccaaaggtcccaccttctaatactatcacattaggggttaggatatcaacatgtttggggagacacaaacattcagtctattgcacagccttttaccttctgcaaataaaactgcttccagtatacccaaagctgtactaaaacctctttttttttttttttttttctggttttcctaggcagagtatttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgactcccccacctccctcccggacggggcggctggccgggcggggggctgacccccacacctccctcccggacggggcggctggccgggcggggggctgacccccccacctccttcccggccacctccctcccggatggggcggctggccgggcagaggggctcctcacttcccagtaggggcggccgggcagaggcgcccctcacctcccggacagggcggctggccgggcggggggctgaccccccacctccctcccggacgggacggctggccgggcggggggctgaccccccacctccctcccggacgggacggctggccgggcggggggctgacccccccacctccctcccggacggggtggctgccgggcggagacgctcctcacttcccagacggggtggctgccgggcggagaggctcctcacttctcagactgggcggctgccgggcggaggggctcctcacttctcagacggggcggttgccaggcggagggtctcctcaattctcagacggggcggccggacagagacgctcctcacctcccagacggggtcgtggccgggccgaggcgctcctcacatcccagacagggcggcggggaagaggcgctccccccatctcagacaatgggcggccgggcagagacgctcctcacttcctagatgggatggcggccgggaagaggcgctcctcacttcctaggtgggaaggcggccgggcagagacgctcctcactttccagactgggcagccaggcggagaggctcctcacatcccagacgatgggcggccaggcagagacgctcctcacttcccagacggggtggcggccgggcagaggctggaatctcggcactttggggggccaaggcaggcggctgggaggtggaggttgtagcgagccgagatcacgccactgcactccagcctgggcaccattgagcactgagttaacgagactccatctgcaatcccggcacctcgggaggccgaggctgacggatcactcgcggttaggagctggagaccagcccggccaacacagcgaaaccccgtctccaccaaaaaaatacgaaaaccagtcaggcgtggcggcgcgcgcctgcaatcgcaggcactgggcaggctgaggcaggagaatcaggcagggaggttgcagtgagccgagatggcagcagcacagtccagcttcggctcgacatgagagggagaccgtggaaagagagggagaccgagagggagagggagactgagagggagagggagaccgagagggagagggagaccgagagggagagggagagggagaccgagagggagagggagagggagaccgagagggagagggagagggagagggagagggagagggagagggagaggaaacctctttctttagcactattcatgttctcttctcctggacgtcagtaccttaaatagagtcatcctccctcatggactccacacttctctctctctctctctgtctctctctctctctctctgagatagggtctcactctgtcacccaggctggaatgcagtggcaagatcatgggtcactgaaacctccacctcccagggctcaagtgatcttctcacctcagcctcctgagtagctgggactacaggcatgtgccacagtgcctggttaatttttgtattttttgcagagatggggtttcactatgttgcccaggttgatctcaaattcctgggctcaagcaatcttcctacctcggcctcccaaagtactgggattataggcatgagccactgtgcctagccatatatccttctctctcttatcctactccagtctggctttggtccgcacttgttcactgacattcctctctgtgacatgatgagttctctgtgggcacactgagtttgaggtgtcaaagcacataaaaatggaaaggtctactaggcagttgtttatgtggtccaactctcttttggttcatatttgcttggtgtatctttttccatccctctattttcaacctttctttgtggttttattctaagcgtgtttcctgtcacaggtctgtagttgaattaacaacaacaacaacaaatccaatctgataacctctgttttcaacaggcatgtaatcatttatatttattttgattacttatgtattggaacttatttctaccatcttatgtttgctgtttactaccccgttccccctcatcttttcccattatatgttagatggataaagtttttgaaattgccccattacacattttattttttcctttgctggttctgaagttatagatggtatttctcctcatttagtggtttccattaatttttaaagttcctgaatctcatgcttccagtatcaacatgcctaaccagcagggcctccattaatttttaaatatatgttctaaattataaatttaagagccaggcacagtggctcacacctgtaatcccagtgactttgaaggctgagttgggaggatcgtttgaggccaggagtttaagatcaaactgggtaacatagagagatcccatctatacaaaatttttttttcaatgagccaggtgtggtggcacatgcctgtagtcctaactacttgggaggttgaggtgggaggatcccttgagcccaggaatttgaggctatagtgagctaggattgcagcactgcactccagcctggataacagagtgaaacaaataaaaaataaatacttatgtttctataaatttacatacatagataaatattaaaaatatattaagccagctatagtggcacacacctgtagtcccagctacttgggaggctaagctggcaggatttcttgagcccaggatttcgaggccagcctaggcaacataatgagaccccatttctttaaaaaaaaaaatatatatatatatatataaatatatatacacacataaacacacaaaccaatatccaaaaaatatatctttaaaaatgtattgtctcagccggacatggtggctcatgcctgtaatcccagcactttgggaggccgaggcaggtggatcacaaggtcaggagatcgagaccaccctggctaacacggtgaaaccccgtctctactaaatataaaaaaaattagccaagcatggtggtgggcgcctgtagtcccagctacttaggaggctgaggcaggagaatggcgtgaacctgggaggcggagcttgcagtgagccgagatcgtgccactgcactccagcctgggcgacagagcgagactccgtctcaaaaaaaaaaaaaatgtattgtctccagttcatcagtatatgtattatctacctactcttaaaagaataaaggccaggcgcagtggctcacgcctgtaatcccagcactttgggaggccgaggcaggtggatcacgaggtcaggagattaagaccatcctggctagcatggtgaaaccccgtctctactaaaaatacaaaaaaattagccaggcatggtgacagatgcctgtagtcccagctacttgggaggctgaggcaggagaatggcatgaacctgggaggtggagcttgcagtaagccaagatttcgccactgcactccagcctcagtgacagagcaagagtccgtttcaaaaaaaaaaaaaaagaataaagacacagtgaatcaagttctttaaaagcagagccaagaagagtcctgtgataggcagcttctgacatggccccaatgatttctgccttctgatatttacacccatgtggaaatccctgcacttgagtgtgggctgaacctagtgaccagcttctaatgaacagaatatggcaaaagtgataggatgtaggatgtcacttctatgattaggctccaaaagattgtgacttctgatgtgctagttctctctctctgtcactatctcttgccctcttctttgctccctctgatgaagccagctgccacagtgtgagctgccctatggagaggcctctatagcaagaaagtgaggccttcagtccagcaaccctcaagcaactgaaacctgccaacaaccacatgagtcagcttggaagtggatccattacccatcaggctttcagatgagaccacagccccggctgccaccttgattccaacttcatgagagatccagagacagagaacctagctaatctgtgactagattcctgactcacagaaactatgagataataaatgtctgttgttttaagctgctaaattctaggtaatttgttacacatcaatacatggctaatacaaagattttttttttctgtgacaactttttttatcatatggagaggcaaaggtggcacagactctacaatcagccaaacgtggctgtctcttgccttgggcaggttatgtaatccctgagctcagtcttctcacttgtaaatcttttttgttttcttccccttcctccctccctccctccttccttcttttttttttttctttttttttcttgacagagtcttgctctgttgcccaggctggagtgcagtggcatgatctcggttcactgtaacctccacttcccaggctcaagcgattctcatgtctcagcctcccaagtaactgggactataggcatgtgccaccacgcctggctaatttttgtatttttagtagagatgaggttttgccatattggccaggctgatctcgaactcctggcctcaagtgatccacccacctcggcctcccgaagtgctgggattataggcctcacttgtaaatctaagctaacaatgcctgccttgcatatgagcttttcagattgttaataaggtttaagagggcatggcacacagtaggtcatcatctttatgacctccattcttgtaaatctgatgctcattccaatttcagtgttctgggttcttcaaaaagtccccaccactaaaactttgctttatcatgaagatttcactcagtccattgtgtgatagtattcataaagcacctgaaagtactacctctcaaatgagtatctcccgttctcaaaatcaatgccacacatagactctaattcaaccatggtacaggggatggtgaattaggcctggagcctctaagcaatggcctgccatccaacatcaaatcatgctgaaaatcctttttttttatactaagacaaaaacacaatcaaagaatcattgcagtttctatgtgaatgaacctcatatgaaatcctctgaacagcagtggctcatatctgagagggaaggaggatgtgagaacatctacattactagatcttcatgaatgggctgctgaagtctggcttttccctgtactaaatctctctgtaattttgtgcctgctcatggaaactgcattcacaaatagtatattatgcatatacacagacttacacagacaacctttgcagataaaaagcaaatccctgccaatgataaacaaaatgaacataaaacctattacagtcttagattatcttctaaaccttacattctcttatgcttaattcttttcatttttaattttaatttttaatttttttattttcctgttctcctcagctgctcataatttgtatttttagagacagggtcttgtgctatcacccaggagtgtagtgacctgatcatggctcattgcagcctcgacctcctgggctcagtgatcctcctacctcagcttcctgagtaactgggattaacatgcccggctaatttttgtatttttagtggagatggggttttgccatgttggccaggctggtctcgaactcctggcctcaagtgatctgccagcctcggcctcctaaagtgctgggattacaagtgtgagccaccgtgccaggcctatgtttattatgtatatatttttacatttaatatgcataccttttcttatattcttgtatttcatacacataatggtcagcagcctgtatatactaccctggatcttttttttttttttttttgagatggagtttcacccttgttgcccaggctggagtgcaatggcacggtctcagctcactgcaacctccacctcctgggttcaagcgattctctggctggcattacaagtgtgagccaccacatccagccttaccctaggtattttagaacaattacagacagtaaatacctatcaatctatacctatatctacatatcttaagaattttattaaaaatgatcaaaagggaattctctcctttttccttctaattcagatctcgagttgcactgttgaagcaatgtgccaaaattgcttttattttcctaaattaaaagatgtgatattatctattcttatcagcaaagggtaaaaaaacaatttattacagaagaaaaagcgagataaaaacataggatggtaggctgggcgtggtggctcatgcctgcaatcccagcactttgggagtcagaggcaggcggatcacctgaggtcaggagttcgagaccagcctggccaacatggtgaaaccccgtctctattaaaaatacaaaaattagccgggcatgatggcaggtgcctgtaatcccagctactcgggaggctgaggcaggagaaacacttgaacccgggaggcggaggttgcagtgagctgagatcatgtcactgcactccagcctgggtgacagagcaagactccatctaaaaacaaaacaaaacaaaacaaaaacaaacaaccaaaaaaatagaatagtccttttcctttcaggattgcaaagagaacataaagaattaagcggcatactttcctaaaatcctgaaacagaaacctttcatcaaagttctaattctactccctctagacggtcatcctcccagctcacccagctggctgcccagtcagtgactaagagcagagctgttttggctcaggctgaagttaatctgtgccttgggcagagacaaactgttggtgcctgtaagagtaaaatcctaaatgattagagcagaaaactcttctgaattaagggtctgcaagacaaacaggttgccatagacatttataaggaaacagccattagcacacccatatgatacactttgctctttttttttttttttgagacatagccttgttctgtcacccaggctggagtgcagtggcacgatctcggctcactgcagcctctgcctcccaggttcaagtgattttcctgcctcagtcccccaagtagctgggactataggtgtgcaccaccaagcccggctaatttttgtatttttagtagagacagggtttcaccatgttgggcaggctggtctcgaactcctggcctcagatgatctgcccccctccttggcttcccaaagtgctgggattacaggtgcgagccactgtgcccagcctcactttgctctatcttttggcctggtttccccaggcactgtggagggaacacaaatatgagtcactgttcctgtcctccaactgcttcctgcctcttcagggagctcagccctgtactgtccaaagagaggactaccagactgggcaatatagcgagacaccacctttacaaaaaattttttagaaattagctgggcatggtggcacacacctgtagtcacggctacttgggaagctgaggtgagaggatcacttgagcccaggagtctgagactacagtaggctatcacaacactgcacgccagcctgggtgacagagcaagaccctgtctaaaaaaaataaaaataaataacaaagaggggactagcagagccatgtgggaagtagtaagtcacttgtagtaatagccacttgtaattaatcacttcacagatcaaagtagttcatatttagcctactcatcagcacctgactataaaggtgtcaggccagagtctccatttcacaacttaaattaaagtgattgttctcggccaggcgcaatggctcacacctgtaatcccagcactttgggaggccaaggccagaggatcacttgaggttaggagttcgagaccaacctggccaacatggcgaaaccccatctccactaaaaatacaaaaaaaaaaaaaaattagctgggtgtggtggtgcgtgcctgtagttccagctactagggagactgaggcaggagaattgcttgaacccaggaggcagaggttgcagtgattcaagatcacaccactgcacccagcctgggcgagagagtgagactctgtcaaaaaaaccaaaacaaaacaaaaaaaaaacaccaccaaagtgatcattctcatgtttgaattgggaaattaatttagactaaccaaactttagttgcctccttctcgaatgacatcagttcacttcccttccttcagctgccctccctccttcctcttaggccatttgggctgccaaaacaaaatatgataggctgactagctcataaatgacagaacttgagaaacagttccggagcctgggaaatccacaattgaagtgccgcagattcagtgtctggtgagggccactttctgggtcacagttggtgcctcctcgttgtgtcctcacatagtggaaggggcaagggaactctctgggtcctcttctcactgatgtcactcactaatcatcattcaaggccccacctcctaatatgattatattgggaataaggtttcaaggtactacttctggagggacacagacattcagataatagcactgccctctctcaattccttgagcatggctcacctctcctccagcccagggcacactgcatgaccatcagttgttttctggggtcaggctctggacctgaacccacaaggtcaggcacattcacttttgtattacatcccgggctcagcatggggcctggacccatgtaaggaggcaaatgagtgttaagggaggctgaaggtttgttgaaacttttggagtacctcattcacatgttcattcgttcatttactcactcatccaacagcatttttttttttgagacagggtctcactctgtcacccaggctgaagtgcagtggtgcaatcatgactcactgcaaccttgacctcccgggctcaagcaatccccccacctcagcctcccgagtagctgggaccacaggcacacaacgctatgcctggctaattttttcattttcagtagagacgaggtctcgctatgttgcccaggctggtcttgaactcctgggctcatgtgatccgcctgcctggcctcccaaagtgttgggattatagacgtgagccacggcgtctggccaccagcgatttcttaaatgtctatacacgcctgaaactgaaataaggccgggaagtctcttgcccacttagcaattacagagaagggatatatgggtttatagtaaatgtgacaagtaagtccagggggccctgggaacacacaggagaggcacagaacttgaacccagggtgtcagggaaggagtcctggggaaagtgaggtctcagctaacatctgaaggctgaacaggagtttgacatatgaatggggtgaggggatgtgggagctgggggccggatatctgaggaaacagttcagctttatttcagctggccgtgtggctttgagcaaacaagtcacaaaaattctctcagattcccattactaaaatggggataaaaggagctgcctcggccgggcgcagcagctcatgcctttaatcccagcactttgggaggccgaggcgggcagatcaggaggtgaggagttcgagaccagcctggctaacatggtgaaaccctgtctctactaaaaatacaaaaacttagctgggcatagtgccgggtgcctgtaatcccagctactcaggaggctgaggcaggagaactgcttgaacccaggaggcggagtttacagtgagccgagatcgcgccactgcactccagcctgggcgacagtgtgagactccgtgtcaaaaaaaaaaaaaaagaaagaaaagaaaaagaaaaagaaaaagaaaaggagcttcctcgtgcatccgttgtgagggttaaatgagatcatgtgggccaagtgcctggcatatagtagatgctcaatggacatctgatggcataggggcgcctcagcaatccctcagcatgacaccctgtattaaagccaggtagatctcttgtgttttgccaaagatccattttgagatcctattcaccttggctctcaagctgagagtagactaagaaggcctcaagtgttcagctagtgatgacagctgagcaaaccaataggtagttactgcacacgccaggccatcagatgccaaaaaattttgttttgcaaattatatagaccaaaagggaaattgagcctgaaagttccagtgtgtggatgcgagaacacactaaagaaatctctacctgaagcctggggaaggggctgctgatggtgctcttctcacatcatactcagctcctgccaccattagcagcttcatcttccttttaaaaatttttattgaaaatagagacaaggtctcactatgttgcccgggctgctcttgaactcctgggctcaagtgagcctcctgcctcggcctcccaaagtgctgggattacagacatgagccatgtcagcagccatgttctaagctagcagcttcatgttctaagagggcagatttcaagtttaggatcctgaatttctctgtatggaagtgagcagatcacaccttctcaagcagggaaatgctcagctctgccaaaaagagaaacaagttattgagactgagaaatccgacatttttggtgagttagctgagtttgcaaacagtaaactgtgttttcaaagacataatgctgtagcaatatcttcagaataaaatcaggtaatgtaattgatcctaaatttgttattttggagccaagtaatcaatagctgcctggtgacctgggcatcttccttctagatcatggctctgtgaggacagcagctctgcccatgttgttcaccacagggctgaacaccgtgccacatacttggcattcaaaattgttttttctccaacctgggcgacagagtgagaccccgtctctaacaaaaaaagaaaaaaaaattttgttgaatgagtgaattttgattagatagatctaatacattgtataacgttcataagtgtttctctcctaagtccaatcctgaattcttgtgtaataataacctcattgaattattttagcagaataattggatatcaaggatgggtgtgtcggctaccaaatcactccatcatattagacttctctctttgagaaccctgacatggctccatgatccataggaacacacgtgtctgtgtgtgtatgcatataatgtacacacatctgtttgtccgaacaacggccatataaagattgtgtaactgtcaagagcctttccagctcattagatgggttcctggacatctcttaactctgtggttcagctttccccctgcaaagtggagatgtatttcagtttcctatttcagtgaaagtttagaagaattatcgtgacatcattttcctgaatgacaaatgtccacttagctgcagggaattccttctaggaaactgaagatcaaaaattgaaaatttatattacaaagcaatattaagatgtacgcctttttttttttttttgagatggagtcttactctgtagcctaggctggagtgcggtggcacaatcttggctcactgcaacctctgcctcccgggttcaagcaattctcctgcctcagcctcctaagtagctgggattaccggcgcacaccaccacacctggctaattttttttttgagatggagtctcgctctgtcacccaggctggagtgcagtttcacaatctcggctcactgcaagctccgcctcccaggttcacaccattctcctgcctcagcctcccgagtagctgggactacaggcgcccgccaccacacccggctaattttttgtatttttagtagatatggggtttcaccgtgttagccaggatggtctcaatctcctgacctcgtgatctgcccgcttcggcctcccaaagtgctgggattacgggcgtgagccaccacgcccagccacacctggataatttttgtatttttagtagagatggggtttcaccatgttagccaggctggtctccatctcctgacctcgtgatctgtccgccttggcctcccaaagtgctgggattacaggtgtgagccaccgcgccaagccagggtttttgtttttgagacagggtcttgcttggctgcccaggctagactccagggacacaatcatgactcacagcagcctcgaactcccagactaacatgatccttccacctcagcctcctgagtagctgggaccacaggcatgcaccacgatgcccagctaattattttttaatttatactttgtagagatgggggtcttcccatgttgcccaggctgctctcaaactcctgggctcaagcgatcctcctgcttcagcctcccaaaatgctgagattacaggcataagccatcgcacctggcctgtatttttttttttttaagagatggggttggctgggcacagtggctcacgcctgtaaccccagcactttgggaggctgaggtgggtgaatcacgaggtcaggagatcaagatcatcctggctaacatggtgaaaccctgtttctactaaaaatacaaaaattacccaggcgtagtgtcacacacctgtagtctcagctactcgggaggctgaggcagaagaatcgcttgaacctggcaggcggaggttgcagtgagctgagatcatgccactgtactccagcctgggcaacagagcgagactccatctcaaaaaaaaataaaaagagagacggggtcttgctgtcacccaggctagaatgcagtggtgcaatgatagttcactgcaacctccaactcctgggctcaaggaatactcctaccacagcctcccaagtagctgggactacaggcatgtgccaccgcaccccgccaattttttttttttttagtggacacagggtcttgctatgttgcccaggctagcctcaaactcctggcctcaagtgattatcttgccttgcctcccaaagcactgggcttacaagcatgagccatggtgcccagcaatataataatactgtactagagaatgtttttgaaaatcttcagcaaaaatgatacttctttgtatgaggagagatttccagccacttagtgccaacaagttcctgatggagattacaatttaacattatgggtttggttttgagaccaactgaaaattccaactactctttggcaatagaaagaattttgtaatagactgagcaaacatatcaaaacaggtgatttttgactgggcgtggtggctcatgcctgtaatgccaccactttgggaggctgaggtgggcggatcacctgaggtcaggagtttaagaccagcctggccaacatgatgaaaccctgtctcttctaaaaatataaaaaattaggtgggcatggtggcgggtgcctgtcatcccagccactcaggagactgaggcaggagaattgcttgaacctgggacacggaggttgcagtgagctgagatcgcgccattgtactccaacctgggcaacaaaagtgaaactctgtctcaaaaaaaaaagaagggctgggcgcagtggcttatgcctgtaatcccagcactttgggaggccaaggtgggtggatcacctgaggtcaggagttcgagaccagcctggccaacacggtgaaaccccatctctactaaaaatacaaaaattagctgggcatggtggtgtccatctgtaatcccagctacttggcaggctgagggaggagaacgcttgaacccaggaggcagaggttgcagtaaatcgagatcatgccactacactccagcctgggcgacagaacgagactccgtctcaaaaaaaaaaaaaaaaaaattagcaccttcacattggttattcacactaattaggcattcaaattgtataccatcacttgcccacagtataccttgtagagacacttacttggtgaaagttcataattgctttaaaaaacttttttgaatttccagtagttatcaccacaatttctaagacaagaaaggctgttgtgtcatcagggttggtttctggtgaggcctctctccttagctttcaaacggctgccttcttgctgtgtggcctcacatggtcttttccccgtgcatgagcgtccatcacgtctcttcttataaggacaccagtcctattggattaggaccctccttttatgacctcatttaacctgaattacctccctaaaggccctatctcaaatacggtcacatctggggttagatcttcaatatatgaattaagggaggggagacacaattcagtccatagcaccccctttgcaaacaatctaccccaaatgcatctagtgatacacaagatgttttactccatttacttgctttgatttcagtacatggtttcttctgggaaaataaaatctttgggatgaagaaagtggtccaaaagctggctggacctctatggctactaactgccctataggctggcatctgtttttactctttgtgaaacctaaacctacagtaggttgttcagggatactacaagtaagtattcagagaaatcttggctcactgtaacctccgcctcccaggttcaagcgattctcctgccttagcctctccagtagctgggattacatgcccggctaattttttaatttttagtagagacagggtttcgccatgttggccaggctggtctcaaattcctgacctcgggtgatctgcccacctcagcctcccaaaatgctgggattataggcgtgagccactgcgcccgacccagagtttcactcttgttgcccaggctagagtgcaatggcgcaatctctgctcactgcaaactccgcctcctgggttcaagcaattctcctgcctcagcctcccaagtacctggaattacaggtgctcgccaccatgcctggctaatttttgtatttttagtagagacggagtttcaccatcttggccaggctggtcttcaactcctgccctcaggtgattcgcccaccctggcctcccaaagtgctgggattacaggcgtgagccactgcgcccagccagttaataactttttaaagcttccatgagcaacttacatcactcacacatgctatgctaacactacgtatatgtacatatttatcacctaatcttctgaaaactcaattgatcataagattataaacacacatactgcatttttccctaagttgccaaacttagtctcctccccccaccaacccccaccaaaaaaactctttctcttcaagttgccataataaaggtctaaaatggggttgatgatggtgataaaatccttactatttaaatggctactgatttataaggcaagctatatttattggaatgtgggattctttttagcattttattctattcaaataggctttttcttttattcataagctaaagattttcttttcttccctcttgccttctttaattgtattacttttgtttgtgtttctctaaaagaggttatatagtttattctgtttgactataccatattacaaccattagggcaagatcccaaagaaaaacaatgcacctctcacctcctacggcgcctgcgcagaggtactaaagtgaagtatgcatgttacaaggccagccaccctcagaaacattcaatgatgactaaatgctcacactttatctgaacctttgatgtgttgtacccagctctctaatcctctgcacacgatcttcctcgggacaagacctgatacaaagatcagtgtgtgttttcagcagtggaggcagcactgggctctttgagtttccaagctaattaagggaaatttgtcccagttggtgaaggcagatgccttaggggtcagtcttcctaacattttgggcaccaagttaaaaaatcaacagtcccccttcccttcatcatgtgacttaccccagggcaatgaattgggtcccctctgctccatccctataaatcatacatttatacatactgttacatattttattcatttatttgtgagacatagtcttgctgtgtcacccaggctggagtgcagtggcgcaatctcggctcactgcaaccttcgcaacccgcgttcaaatgattctcctgcctccgcctcccgagtagctgggactacaggcgtgcaccaccatgcccggctaattttcgtatttttagtagagacggggtttcaccatgttggccaggctggtctcgaactcctggcttcaagtgatctgcccacctcggcctcccaaagtgctgggattacaggcgtcagcctccgcgcccagccttgttacatactttcataatgcttgtaatatatacttctatttcaacttacataaacatgaaatgtaaaaatttcaatctgtaaagaggtaagtggctacctcacctacgatgtggtaaataagacgtgtcaacgcagccatcctgccccagccgaccagaccttaatgctccaaaaccatccgtttgcgcctggaaaactgaggaaagtgtttattcccttacacacgcttcgccaaaggccctggcacgtagggctttttcactgctgcgaacgttagaccggcctgtgataaggagtacaattaatctaactttggtatactatatccagagaccacagggggctcgctctgcgatttatggtgcgaggaggaccagacaccccctgtgcccgtcctactcctgcagatcaaactcacagccacacttttcggaatgagaaactggacagtaaatgaacgcaagaaccatggtgcccaggcagagaaccccgctgggtttgctacgaaggttgcggtggaggcgcccagtgcaccaggcgccaaggcccggtatgtgacctcactaacctccgccagcgcgcaccctgtcctgccccttctcgggccaacaaccccacacgacgcagcggtgtgagaaccagcaaccggaaccgcaaaagcacggctttcccggagcccgggctctggactggcacccactgcgcatgctccagagcggcgaccaatgggagcccggcgcgcagggacggaggcgggcccgggccgctaccgagaagcacagggacccgacttcagtcatcgaccaatcagagctcacagccccccacaccccctcccccccggccctgagccaattgccagctcgtgtgcgggagggccgggtcaagactaagtcaaaggaggagagggcaacgcggtgggcaggagagaggccaacggccgcccggggcgaggggagccggtaggacgggaccaggactggccgacccggccccgcgcggggaagggggcgccttcctcccacaacacaaaacggtgcgcccgggttggccgcccctccccagtggtgcggccccgggtggacgcttccgtgcgcgcgtccatgcccagccattgcgggctgcgggctccaagggtcgcacacgctggagagtgcaggttgccgggtccacccacagggctgtagacacccctagggtcacacagacaaggctctggacacccacaggggcacacacattggggagtgggcactcctgggctcacaaagactgaggcgcaggaaggtagggcgcgcccgcccagagggagttggtggtggctgagggtgagggcaaggtagggactgggaggagacttctggttccctggttggtcctggtggggcctgactgggccagggttttcctgtgcaggtgcggggagtagggcggggtctctggttggcggggagggctccaggagcctgtcccagccctgggggtgtctggctgagccccacagaagggaactctgagatgggctttgcagcaggggaaagaaaagggaggtcgcgcatactggcttcctgaccatccaccaatggtggtggaacctggaagcctgagggaggaaggtgaggaggcgcttgagggaggggggaatctaggcgtcagggatgatagttcattgatccaagttactcagctatttcatagaaacggcaacagtaatgaataattataacacgtgccaagctctcctgatcactttacacaaatcatctcactgcatcttcacaacaaccttaactactattatcatcttcgcgttctggatgagagacctgaggccctgtagaggttaccagaaggcacacagctgagaagcgccagggccagggcaagggtcaggctgtgcactctggactctgtgttctgaccactgcgtcattgactctacagatgtctctgctttctgtgctcaccctgtcctcattccgcccccggcaggacagagggcccctgaagcatccatttgcccacagcgtcagtgaactgtgtagaactctctgtgcaagggagctggcccctgcgcaccctgagtcgtttttcttccctggctccccacgcaggggcagtgaacagaggagagggaagccttgttggaagagggcagtaaatcacagcatagctatccagactgcaattatttacttagtgcattcagggtcttgtgctaggtggtggggataccgcactgaaccagacagacaagggtcctgttcctgcctgccctcggggtgtgttttgggaattcctccttgagggtgctttggcattgaatgggcagaggtctggtgctggggggctgtcccacaccagcaagacttgtaatgtacatgaatgtgaatgtcatttcaggatagtaaaaggaggcctccaaaaatgtttcttattaaaagggagcattgggtctgagggttgggaaatgatatttccttaggtcaggcctgtcccaggaagcaaccctcagtcagggatacggaggaccatgaagatagtacggtgaggggaggaggaagatacagcaacgtaaattttgccatcttggcctcagtttggttttaaaggacagcagttggaccctccccatgcctaggtctcctgcatggattcagtcagtggtggcccaggtgtggaagacaccccccatgtcttattacctactctgggcttggggtgtggtgatcaggaccttgtagtcaatatcttcccaacaagaagcaaaataagaacaagatataaacaggaggtgattcatctggtgcccctaggggttggaggggaaggtgatggggtccatcctggttcttgggggttcctggtgtttgctgtattactgtgaagtaaattaacacttctgctgtgtgaactggcttgcattagaccaactctcctgctgagagcaaccagaaaagctggattaaagttcctgtttttgtttttgagtctatttgaaggcccaggagagcaaattatctttgaggtcatcacctcaccaagtactggcatccagtgcagaacagcaagagttgatgagaacatcagactagaagaacggagtgaaaaaaatttaaattttttttaaaaagagtttgtggatacatataaacgtaataaaccagctccaaattattgatgccagtcaatggagtaatcaaaaaatatgaatatgaaaagtgatactaaaatgattagtaaatcactatagtctataatgggaaaactcattctattagggactaaaataacaaaaatgtgctttaagtttttctttcttttttttttttcaagagccgacgtcttgttctgttgcccaggctagagtgcactgaggcaatcacagctcactgcagcctcgatttcctaggctcaagcaatcatcccgcctcagcctccccgactacaggcatatgccaccacacccagctaatttttaaaaaactttttgtagagatggggttttgctatgttgcccaggctggtctcaaactcctgggctcaagcgatccacctatcttggcctcccaaaatgctggattacaggggtgagccaccacgcccagcctgcttcaggtttttttgttttgttttgttttgttttttagagaaaaatatacattttacacttgtctgctacttagaaataagaacaggaaatatacaactttaaaaaattcattctcataccttggtaacgaaatatccacctttaaatgttaatttataaaacaaccagcacaaccagcaaggctgttgtggctcacacctgtaatcccagcactttgggaggtggaggagggcagaatgcttgagcccaggagattcagaccaggctgggcaacatagtgagaccccatctctacaaaaaatatgataattagcgaggcatggtggtgcacacctgtagtcccagctacttgagaggctaaggcaggaggatcccttgagcccaggaggtcgaggctgtattgagccgtgattgcaccactgcacttcagcctaggcagcagagtgagactttgtctcaaaaataaataaatagttaaataaaacaaccagcagctgctctgcctatggagtagtcattttttattcctttactttcttaatacatttgctttcactttattctatggacttgctccgaattctttcttgtgtgagatccaaaaaccctctcttgggtctggatcaggacccctttccggtaacatcttcctggtgaaccacgaagggatgatactgaggagaccctcgacccaaaggaaaaagactgcagcactgattggccaactttggactgaccctgcttattcctgtgaaccaatcagtgacctgtgacggctcctcagaagaaacaagagggatggacaacaccttttgttggagctcagttatgagtggctcagttatgactgagctcccttctaccctgaatacaagagaccctaataggcaggaatatcatcgcccctattcctcctgaagaagttacagaagatgaatcttcctccctctaaaccgttaggattaagggtttccttgtaaaagggaagggcaaatatgtcagaggcgtttgaaccagagtgattctatcttgaataggggctgggtaaaataaggctgagacctactgggctgctcctgggctactcccaggaggttaggcattctaagtcacaggatgagataggaggtcagcacaagatacaggtcacaaagatcttgctgataaaacaggttgcagtaaagaagctggctaaaagccaccaaaaccaagacagcaatgaaagtaacctctggtcttcctaactgctcattatacactaattatgatgcactagcatgctaagagacacttccaccagcgccatgacagtgccatggcaacatcaagaagtcaccccacatggtctaaaaaggggaagaaccttcagttcccggaattgcccacccctttcctggaaaactcatgaataatccaccccttgtttagcatataattaagaaataactgtaagtatccttagtccagcagcccaagctgctgctctgcctatggagtagccattctttattcctttactttcttaataaacttgctttcacattaaaaacaacaacaacaacaccaacaaccagcaaatatatcagaggcttagcatcccctattcaaggggacagttctggaggccgagaaagaagtagaaaggtggagaataaaagacacaaaggagcagaagaattttatcttggcctccatgtggcacctcacagcttgggaacaacaatttctctcataattttcctcagctccaccactcacaagctgtgtgacctcgggcaaggcacccaagctcctctgggcctcagcttcccagtcagtacaatggggtaacagtagtgcttacgttttttgtgtttttttttgagatggagtcttgctcttgtcacccaggctgaagtgcaatggcacgatctcggctcactgcaacctccgcctcccaggttcaagtgattctcctgcctcagcctcctgagtagctgggattacaggtgtgcaccaccacaccagggtaatttttgtatttttagtagagacggggtttcatcatgttggtcaggctggtctcgaactcctgacctcgtgatctggctgcctcggcctcccaaagtgctgggattacaggcgtaagccaccgcacccggccagtagtgcttactttgtggggtcatctgtgaatgtgaaatgagttaataaatggaaagcacttagaaaagcctctggaaccactgaatcaaattggatatcattactgaaccttcattcaatgcttcaatacccatttagtgtcatctgtccaaatgctggagatacgcctagcacacactgactgctcagtgagcagtgtcacaatgaacacgtgcaatggccttgaaggccacatcggggcttgccctgatcagcaggttggaggtgctccaggcccgaagcttagctgtgagtggggacacgggagggaggttggaactgccactgcagaaggggttctgaacctaggttcaggagagaggctttgaacctgcacgtgtgggaagccatggaagtttccaggaaggactgcaggtcccaactggagatgtgccgttcctccttcaggtacctgggaatgtcagtcacaccccagacctgctcagctcccccaaactgctgttcctgtatctgagagcttcaagtctccaaatggcctacctcatacatggggaaactgaggcctggggaggccggggactgagctagcattcacttgtggaaatagtctggcatcatctggagaagttagagacatgcaaaccctacagccctcagattcccgtctgagagtctgcatgcctatgtggaccaggagatgtgtgcgggagtgaacactgcagtgttgctcccaacagcaagaaccagaagcagcccaaagggctgttacaggagaatatggacacccaggctgcacatgcacaccatggaatgctgtatggcagtggaaataaatgaacagctaccactataggcaaacaggaatcacagcaacagccaagagtgaaggcgtggagggacgagaccatgcactcacacctggcctgcctggctcgcactccgggcaaaggggtcagaacagtgactggcacacacgttaagtgctatgtgagtgttaagataaaactaggatgtccagtggggagaaagcaagcctttgaagattatgtgcttttacaaacttcaagtgcaatgaaaactaaacaagatgttgttcaggcattcatatatgatataaagttcctttctttaaaaaagggatgggctgggcacggtggctcacgcctgtaattctaatactttgggaggccgaggcaggtggatcacgaggtcgagaaatcgagaccatcctggccaacatggtgaaaccctgtctctactaaaaatacaaaaaaattagctgggcgtggtggcgtgtgcctgtagtcccagctacttgggaggctgaggcaggagagtcacttgaacccgggaggcaaaggttgcagtgagccgagatcgtgccaccgcactccagcctggcgacagagtgagactccatctcaaaaaaaaaaagaaaaaaaaaagtatgacaagcagaaagtaatttgggagctgcggggaggcaagggtaagggatggggaagtggaccagaggcatatgcgtcattggcagtgtctaagcactcacgataggcgtggatcacaggggctcgctctgtaattaaaaggaaaagggtttttgttgtgttgttgttgttgctgtttttgagacaagggtcttgctctgtcatcatccaggctggagtgcagtggtgcagtctcagctcactgcaacctccgcctcctgggttcaagcgattctcctgcctcagcctcctgagcagctaggactacaggtgtgtgccaccatgcctggctaatttttgtattttttagtggaaatggggttttgccatgttgcccaggctcgtcttgaactcctgacctcaagtgatccactcgtctcggcctcccaaagtgctgggattacaggtgtgagctattgtccccagccaaaaggaaaagttttactgtagtaacccttccggactagggacctcgggcctcagcctcaggctacctaggtgctttagaaaggaggccacccaggcccatgactactccttgccacagggagccctgcacacagatgtgctaagctctcgctgccagccagagggaggagggtctgagccagtcagaaggagatgggccccagagagtaagaaagggggaggaggacccaagctgatccaaaaggtgggtctaagcagtcaagtggaggagggttccaatctgatggcggagggcccaagctcagcctaacgaggaggccaggcccaccaaggggcccctggaggacttgtttcccttgtcccttgtggttttttgcatttcctgttcccttgctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttggtgagctggggatctcctgcccccgccccgtccccaccgtttcttcctcttcctctcctccttctctctcttcccctcctcccgctcctcctttccctctccatcatctcctctcctagaatttcccgtcataatccacccttcccaggaagatctcaatgtctacttgccttccctctggctgcagctcttcctttgggcccatgactgtcatgaggcaggaaggaccaggtctggctccaagaccttgtggctacccctgaccagactccactgacccctgctttcctctcccagacgctggccactgcagttgttcagctgtacctggcgctgccccctggagctgagcactggaccaaggagcattgtggggctgtgtgcttcgtgaaggataacccccagaagtcctacttcatccgcctttacggccttcaggtgacccccccacccccgactggacttgcaagccagttctcaacccgcaaacccagatctgtgtccatatgtgtccatagcttcaagacctcagacctgatcagtgaatccctgagccccagaaccaaagactcatccagatggcaaactctgacttgcctttctaagtctgcaatgactggccccagtctccgtatcaagatctctaaagcccccagtattagtctgctgcctaagcctaatcttttccacaaattccaataaatgagcactgtatttgtacctgaacctcaaatctattctaaactcaacattttgcatcccaggaatctctcatcaaaactcctgaaccccagatgtttgccaagctcctaagtcataaatctgttcaacaaaccccaaagttgaatattccattgatccttgaactccaaatctgtccttctaaatccacagcacagaccccagagttcccatattaaaattcctgaacactcaaataccgaggtagttcttaagcaaaaagtcttttccacaatcccctgacctgaactttctaggtttaagccccaaattcatccttttaaacccataaagatggacccagcataacttccagatcccaaggctatcaaatatccaccaaactcctaaaccataactctctccacaaaccccaaattgcacttactttagctggactccccgcgaaactcccaagtctatgtgtctgaacttcaaatctcaactccaacccccaaatactagaatcctacctgtcatgaattggggctggggtggtgggggagggcatggattgaatctgtgaatgagcctcaacttcctaagactagagtcctaaattatgaaattcaagcccccaagtcccagatctagggccccaaaccccaaatccaaacctctcacaaaagtgtatggctcccagactataccccacaatccacacccttagacaccaactctctggtgctgagctgaaaatctccaaaccagactatgaggctcccaaatccagacaccctgctccctgcccagctaacaaaagcctgccacccccggcgtgcctcagtgccactgtgcctcccaccctacacctctccaggctggtcggctgctctgggaacaggagctgtactcacagcttgtctactccacccccacccccttcttccacaccttcgctggagatgtaagtgatcaaccagccctcgggcctcacttggggtgtggagaggagatgggaaagttgcgggggacctgggaggcggctgaccccaaggtatgtgcaggactgccaagcggggctgaactttgcagacgaggacgaggcccaggccttccgggccctcgtgcaggagaagatacaaaaaaggaatcagaggcaaagtggaggtgaggaggccacaggggaggaaaggaagttgggcagaggtgagtgcaagcctggggaactagaaaagtcccctctcatggtcctggctcccaatccatctatccacagacagacgccagctacccccaccaccaacaccagccaatgaaggtgagtcctctagtgcaagtaggggtaataaggggctagcccaggaacctgtggcagggctgtgataactctctacacattccatcttcccagagagaagaggagggctcccacccctgcccctgcatccaggtggagaccaaggaggtgcgtgctgattcttccctgtgtctctggatggatgggtaagagtggatggaggaatgaggagttggatgggtgcgtaagtgggtgaatggataggtagattgataggtatgtggatggacgagcaggtgcatggatgtgtggactgatggatgggtggatggattggcggtagatggctgagtagagggatgaattgatgggaggatgaaagtctaagtagatagatgcataggtgaatgggtatgtggataaatgaatgaaaaggtagatggatgactgagtaaattaatcaatgagtgaatgaatgaacagtgaataaatgactaaatgacaagtttcagtcagtgaagaaagcatgattgaatgaataaatgagtaaatgaatattttaacaaattcattagtcaatgagccagtgaatgataaagcatgagggaatgaaaacatgaatgaatcagtgaatgtatgaatggtttgtgggatccacccacttctccatagaccctacttgaacccttcacccactacctccatgaccatccaacacacacacagatttccctcaaggcttccgtttcttgcccctgtgctttggttggttggtaagtgggtcaatgagccaaccaccctattttccccacaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagtgagagccactccccagtggacccacagattcctgggggcagaggggcacatgaacaagtggacagctgagtgaatggaaggatgggcagatgggcagatggctgggtggctgagtgggtaaatgggtggttggataggtaggtgcagggctgggtctagggagaggtaaataaggcaccaagggtacaaaatttaaggaggcactcactctcagaggcatgcaactgtaattcctgactctcagagtgagtgactcacttaaattttgcaccctaggcaccttacttgcctcaccctgggcccactctgggtgggctgttaggagagcaggtgggtgggcaggtgaacaaatggatagatagatgaggtagatgatggatgagaagggctggtgggtaggtgggtgagtggatgggtggatggatggataaatgaatggatgaatgaatgggttgaagaatgaatggataagtggttggatggacaagtttatgggtggatgggttgatgggaggtgcgtggatagatagatgggtgagtggataggtgtgtggacagattgatatgcaggctgattggctcacagacaaggtggatggggatggacaggtggacagatacgtggatgaatggacagttcaatggataagtgaacagaagtgtgtggttgcatgggtagaaaaatgagtggatggatagatggaaaggtgggcacatgggtaggtggatgggtggatggacaagtgtgtgtgaggacagactggtggacaaatgggtgaacagacatatgtgggcagatagttgcagagacagatgtatggacagatcagtagtccaacagatgaatgtgaatgaataggtggacaaatgcatgggatagatggggaaagagggatgggtggatggatcagcaccacaaactatggagcccttctaattccataactcctgcctatactcattcactcattcagtctcattcattaattctggcccctcagagtctctttgggcaggagagggcaagagggtttcactatgaagggagggaaggaagggcagtgaggattcactggagtctcttcacctctcccaggcatgtcagccacgtggggtgggacccccagaatggatttgacgtgagtaacttcagagtctcttggactccactaaacttccacccacccttccaaagaccactgctgagaccccacccccagatcgtgcccttcccacacccctctcagatcccttgctgggatggacccaacgacaatccatgtcgcttgtctcctcgccttattcctctactcctgcccctggcctttttcctcctgggcaggtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccagggtgagaccctgcttccatacgctcccttctctagcccaagcagctcatagctaagatacgcactaagtcactcagtccttatgggagcacctatactgcttcagtcaggagttggtcagtgggggtacccattttacaaatgagcaaaactgaggctcagaagaaatcaatgagagttacagctatgtgttataccccctccacagagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaaggtgaggacaggcaggatggaggattgggggtctaggactctggggtgtcccgtctaagtcaggatactggggggctgaggccaggactgaggagagtgccaggccttagggattcagtgatagggttgaaaggttggtgggaagccttgaaggggactggagtgtgtgggagagaaaatattgatggaggggcggggagaaatgctcctttcccaggccctaagccctctgtgctgatccctgcctgctgcagacccctggggccccagagagctcagcgctgcagccaccacctcagagctcagagggactggtgggggccctgatgcacgtgatgcagaagagaagcagagccatccactcctccggtgagctgatcctgccggggcctcaaacctggctcccagggctagcactggcctcaaaacaatcccagcagtcaccaccaatagtgacatcagccccatctgtttgacagcattaacatgaatcttgtgtcagcctcgtttttgacaatgttaacattaagtcattatgtgacaataatataattaactccaactttgacagtaatattaacattaatgccagggtgtgtccacaatattaatgtcattcccacatgttcagtactactaacatcagctggccgggcgcggtggctcatgcctgtaatccaggaactttgggaggctaaggcaggaggatcacttgagcccaggagttcgagaccagcctgggcaatatagtgagacctcgtttccataaaaactaaattcaaaaaaagtagtcaagcatagtggtgtgtgcctgtggtcccagctacttgggaggctgaggtgggaggattgcttgaccctgggaggtcaaggcagcagtgatccatgattgtgccactgcactccagcctgggtgacagagatcctatctcaaaaaaaaaaaaaattaacccattatgtgatgacaatattatgaagaacactattgttgacaatattaattttaattccatgtattaacagatttacattaattcattatgacgtaacctaatctaatcttttaaaaaatttttttgaaacagggtctcgctctgtgtcccaggctggagtacagtggtgcaatcatggctcagtgcagcctcaacctcccaggctcaagcgatcctcccgcctcagctcccaaagtagctgggactacaggcgtgtgccaccatacctggctaatttttggtgtttttttggtagtgatgagctctcactaccaagctctcactactctcatgttgcccaggctgctctgcaactccagggctcaagcgatctgccccgcctcagcctcccagagtgctgggattacaggcatgagccaccaggcctggctgttaacctaatctttttataataatgttactattactctcttaatctgtcagcaatactgtcactaatccattatatgatgcaaatattagtatcaacctactataggaacttcatctttcgacaatgatttttttttttcttttgagacggagtcttgctctgtcacccaggctggagtgcagtggcgcgatcttggctaactgcagactctgcctcctgggttcaagcgattctcctgcctcagccttccgagtagctgggactacaggcacgccactacgcccagctaattttgatgttattgtcattaaccccattatgtgtcaaaaatattagcgttaaccagacaggaagcaataatatattatcacacctttgctaatattatttaaattcaccctattatgtgataaataggttaacattaaccctttgtttgacaatatctcgactaaccacatttttgacagcataaacttcaactccaactagaactcagaccccaactataatccctttcttgtcccaaatggaaactctaacttgccctcctctagcatgagacctcagaaccccagggtccagtcctcacctcccaggccctatgaagccccccaccaacctcccagggcatcttatctttctctttccctccagacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttatacaaaaattctcagttctcttcactcaaggatttttaaagaaaaataaaagaattgtctttctgtctctctataaatctcagtctgtttacattccaaatgtgggaatggggtccctttcccccaaagtcccttttattcatttatcccattttatttatttagccttacatgtatatattcattcattcatttattccctcagtcatttagcctgtatttctttgtttccttctgcccctctgtctttcaacatttattgtcaggtactattttaggggctaggaatcaagaagtgggaaaaaaaacagacaagaattcctgcccttagggggtgaaatccacattctaggggaagagacagacaagaaacaagaaatcaaatagaaataaaagatagctgcagatcatgataaatgctgtggagtggtaaggcagagatacagatgaaacaacattcagatggagcagtcagggatggtcacttggagtaggtgatggtggtgctggacctaaagagagagaaatgtcggcccagttaatatttggggaaaaggggttccaggctgagggagcagccagtgcaaaggccctgaggtgagaaaaggcttggcatgaggccagatgtcatgcatttaattattttttaaaaaaataattcaatcggctgggtgcagtggctcatgcctgtaattccagcactttgggaggccgaggtgggcggatcacctgaggtcaggagttcgagaccagcctgggcaacatggtgaaaccctgtctctactaaaaaatacaaaaattagctgggtatggtggtgcacacctgtaatcccagctcctaatgggggctgaggcaggagaactgcttgaacccgggaggcagaggttgcagtgagctgagatcgtgccactgcactctagcctgggcaacagagcgagactccgtctcaaaaaaaaaaaatcattcaatcaacacaatactagattaagagcagcatactcaatgagcagacctccccattctccatgcccataacaactcacacaccaggatcttgatgggcaggatccccctctcatttttaaaatttggctctgcccagttcccagttcaaatcaagcactggccaattgcaatggaaaaggcaaagacttaattatcagacagatctgctctagaacccgggaaagatgcctcacctctgagctttggtttccgcatctatacaatggaggtaactgatttccaacggggatcccactgagtcacctctctgcctcctcaggacttgctctcccagaaacaaaggagtaactcaaaagcgtccttggcgtttacagctatttccaagggcataattagaaactgttgcacagcaaagcctagaattgagctccctgccccttccgatttctgaaatctggtgaattcgagatctcagacatcctacctttagaggaggagaaaaagagaaaggtagtggggaggaagataaaggtgagggagactccagagagggcaggcttcttcagtctgcaagagcaacggaagaatttctaggtggaaaggggaactcccccaagctagagaaggagggagtctcaggtttcctttaattcattattctttacaccgcaacaccactccccaccccaccctgaccaggtccccagatgggcactgagtctaggaaggatccatcagcatcatttatccctactcccagtcccccacagaaatcttagaaatccagtgttctggttggccgggcgcggtggctcacgcctgtaatcccagcacttcgggaggccgagatgggcggatcatgaagtcaagaaatagagaccatcctggctaacatggtgaaacctcatctctactaaaaatacaaaaaattagccgggcgtggtggcacatgcctgtagtcccagctactcaggaggctgagacaggggaattgcttgaacccgagaggcagagttgtggtgagctgagatcacgctactacactccagcctgggcaacagagcgagactccgtctcaaaaaaaaaatgtggtatacacaatggaatactattcggccataaaaaacaatgaaatcatgtcttttgcagcaacatgaatgaaactgaaggccattaatttgagtgaaacaactcagaaacagaaagacaaatactgaatcttttcacttgtaagtgggagctaaataatgtgtacacatggacatagcatgtggaattataaacaacagaaacttggaagggtggggaggtgggaaggaagtagatgatgaggaaattacttaacgagtacaatgtgcattattcaggctatggatacagtaaaatgcctgacttcaccactacacaatgtatccgtgtaacaaaattacacttgtggcctggcactgtggctcatgcctgcaatcccagcactttgggaggccaatgcacattattcagttgatggatacagtaaaatgcctgacttcaccactacacaacgtatccatgtaaaaaaattacacttgtggcctggcgctgtggctcatgcctgtaatcctagcactttgggaggccaatgtacattattcagatgatggatacagtaaaatgcctgacttcaccactacacaatgtatctgtgtaacaaaattacacttgtggcctggcatggtggctcatgtctgtaatccgagcactttgggagaccaaggcaggtggatcactggaggccaggagtttgagacctgcctggccaacgtggtgaaaccccatcatctctactaaaaatacaaaaattagccaggtgtggtggcacacgcctgtaatcccacctactcaggaggcagaggcaggaaaatcgcttgaacccgggaggcagaggttgcagtgaaccgaaatcacgccactgcactccagcctgggtgacagagtgagactctgtctcaaaaaaaaaatattatatttgtacccaataaatttatatgaaacaattaaatgcttctgagatctggcttaatggttgctcagcctgcattctggttccacatgtaggtctgcttgtgaaaactcattacagtgttcacccctggtctgtgtacccttctgtatttgtgttacactccaatctgaggtttacattacaataggtcaaacctgtgaataaaaccttatattggctccggcactgggcaacgcagtaatcattaaattaatgctgaatgaacagacaactggctgggagtgggacacggtagcaataagatggcctcttaacttttgaggtctcctgaaaaagtgctagtccagaatgattcactttccagatgagcaggagacacccaccccaaggtcacttactgcaggttttacagaccagtttaagaaactgcctaagatcaagtaatttagtaaatggcagagcctggatatgagtccaggtagtcaggctccagaatccagacttttgcccactactttatagtgtttgggggcactactggcgacagacccttttgtctccctctcagatccagacaggcagaggtcctgtcttaaatcactcttgtgggttggacaggtctcctggacacccgggagtgggagagccctgctgcccgaggagactgggggtacatgaggatgagcacctgactctgctcgagaaggagtaagggagggaaggggatgcatggtgggaccttcgctcctgtctgtcccctcagggcaagctggggctgacggaacctcagaccagccagtcacttcttaatgagctcacagctggactggcaggcagacagaatatccgtttggttaactgtataactgtttggttgactacagaactcatggagtgacagggagaaggcgcaacttgaggacgtgacagcgcagtttcctgaacatctaactgaatgacagcctgcctaggactggctggggctggtagcctgacagtggaaaagacaggcagcctcctgaggaccttgcaggctggctgactgatggcccgtggtgctactgcctgcctgggtggccggatgttgtgaatgactattgtcaggaatcacagctggcgggggaatgtctagatgttatactgtctggcaccgtgtaaaggagggccacctggggaaacttcaggctaactgatcaacagacccgtggctgcttgctaggcagctgtatctggtgatcaactatccacgctgctcgaatcacagcatgctggagggcctggctgggtgctctgactgactgatcacctgacagacggtgcggtcagtcggatgctgagaatgactgacgatgtgatgaggggcggattgaacgagtcacaggccagctggccaggagcaaaatcggcatagctgtctgactcgatggctgtacgtggttacggactgtctgccctgatagaatctcagcttcaacgcatcagaggagactgacttgaccaatggtggggatgagtcgcctgagaaatgacagactggctgacccactgacaggtggtgtggaggcttaatcctacctctagttgctgtgactatttgctttgagggcctagctggatgttgtgactgatcgtggtgtgaatgagaagtaatctgagggaaagacagtgaccaactgatagtgcccgacagggctgtattagatgctgacagtgacagcttgtcccgacctaatcacagcccgcctgggggcatggctggatgctgcagtctatgagaggatttagccagggagaatcgcagctggtcccagggctatggtgggtggagaggaggactgattgatctgctgacaacgtgaggacaggatggtcttagggaatgataaggcaggctggctaacagtgctgtctgcctgcctccagggagtcgccgctggccagggcacaaatggaagccagtattgactgcccagcagtgtggatgggggccgggagtctgactaggcacctgtctggggcgaccgcctgagcagttggatacggcactagtccacctgggagccccggcctgcttggggttaaaatgagatgacgggctgactgacggtgataacagggagtatgacaggactgaggaaccactgcgactggctgataacgtgattggctagcagtgtgacagacagaccagcgcacgggcagggcctctggcaactttagctaccgccgctgtcgctcccgctgccgccgccgcccagacgcactctgggaaagcgcggcgagcacccgcctccgggaccgagccgggcggcagggaggggttcggtcacggctctccggttggtccgcgcgggtgctgcgagtcgggagccgcggccaataggctgcgcgttcccggccacgcccgcgcgagcgctcttctcgcgaggccggctaggcccgaatgtcgttagccgtggggaaagatggcggaaaatttaaaaggtgaagcagtggaggcagaggcgcgggcccgctggccgggccgggtgggctggaggggtggcgttgccggctcggggccccggcgtccgaggccccggcgccgggagccggaagctcggcgcggaaaggatgaggctcggggagcgcgggcctggtgcgcggggctgggcggggctcaggggagggggcgcgcgcctcggaacgcagcgggcctggggctaagtggggacgcaggaggggggcgcgcgctgcagatcgcggccggaccggcgcgcgcacgcgcgggggcttgtcgaggaggccgcgcccgcgcgcgggaaaatcggcccctggtgaccgttacccattcggtgtccacgcgagacgccggaaggggagggaagataagggggacagacccccccttcagagtgcggggactgagaactcttctgggggaaagtatcgcctctcggcgtgatgggggaagggtttggaatagaggatctcccagaagagagaaatggggccttcctaataggacagctggactcccccatgtgcagggaaagaggggtgactcagttatgttggggggcccctctatgtgacgaaagccgcagggaggatgggttccacaagtgggaggacctctgaggggttcaggagagtccacctgtggccagttccggagccagcagctggagggtgttaattgggaccacttaagtggggtttcaaatgcaagtgaaggaaggggtttgcgaggacaggctgtagggagaggaaagcgtgggcacaggcgggctcagtctccacttggtcttgcctaagtagggggggtagggcttgcacacgaaataattttgaaaagctcttgtacgtttttaggttgacatctaaagtttaggtgtgatttttgcaatgggaggcagaaaatattaaacattttaaaaagatgatataggatgaggactgactgcccttggaatgttttgagacatgatttgataaaatggcttctaaagtactttgattaagaatgtgccttgaatcagaaagaaatctgttttttaaaatccgtgtgtcttacaaaattttggcagtcccagaaatataccaggtatatttaaaagaatcagtgtcactaatctgtaccgctttgcgtataaattcagagcataaccctttggatgagctttactcttcacagaaagatggatgagacagaaagtcaaaatgcagtgtgaaaaaatataccttgtggatttaaggcacccagattgatcatttaaggagccttcctgtaatgtagtatcattccacaatctcttgctcataattccgaaatctaaaaagccctgaaaactgaaatccttttcttaaatttggcaccatttatggcaaaagtagattataaagtggaactcttctgtgaggctattttatatctctatttctcctatttaatgtgggaaattcatacttttgctgcaggacggttaatgcatttgattatagcttgatgtcccctggccacgctgggggtgttaggtgatgtatgggatatcctagaactagtcttgtaaaatccaaaaaattttgaattccaaaacacatctggcccaggagtttgagataagggattaaagaccagtctttccagttacgcctttgtttggtgccctggaggttttaatcttgtcctcccatccgccccacctcggggcactgcatcctactgagatggggggttgttctctttcttttgcaaagtggagagaggggtgatcaggtcctgaacccaaagcaggtttgcaggcagttttaggaatgacatggagtttgaagctctggaaatagattcctttaggacaattcatgttgcaaaccccgcttagaggtctgctgctccaggggcagctttgggcagtgagtattggggttcaaagcacatttctgttgtagaacagtctcagcactggggaaggcctgtggattaaatttccctgactcttagtcagtctttgggatgtcccagggaggatttggggtcccctttgactcctggcctagtcaggctgcccagtaatagttctttctgccccgcttgatccaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgtgagtctggggtgaccatgctctgggaggggacaggtcacaaggaagttagtgtcctgccctcttgtccccaactgcccacatctgtttccaaagggaattttctcctttgaccctgaaaacacaggatgaatagacccttttatccctatgttacagatagggaaactaagtagctttctgggcaggagccggaatgaattcccaaataaatctcttcccatctccctaggaatacaaagtaattgcagagattgagatgctgaaccctggagtggaaatgtcaatagctaatggctattgagcactttcagtgtgccaggcgtttcctctcggaaactcatttaatcccctaacaactgaaatggggatagttattgccagaagggggagtggcaggatggttaggagaacaaactggagtcagcatgcttgggttccagtcctggttgtgttaccccaggctacctacccaaaccttcagtacttcattttccttgtcgtaaaagagggataactaggagcatctacctcatgtggggttgtgaggattaagttagttaataatacatgtaagctgcctagaacaggcaaggacttgtcagggtccaggtgagccagggtggtggcagtgatgatggtttgtcactggacgtattttgaaggtggggccaacgggatgtgcagagggtgggtgtcggaagtgtgaacaaaagagaagtcaaggatgactccaggagttccggtctgaacagctagaagggagggagctgatgatggggaagaccaaggagaggagtgggtttgggagattaattaaaagttggaacagtttggacagacagtaagggggagaggaggatttgaacctagtaatcctcactctagagcccatgctttttaatcaccgcatgaagtcattccagaaaaggggtggggtggggtaggtgttatccatcagctttgggatggaagccccatgaaggctggcccaaagatctcactacttacggtacccccgtccccctacccacccccaacaggaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagaggtagggagatgggacccggtgtgtgtgtgcagctcttcccaccctgtgttcacagtgtgcacccggctctcctcactgtgtgtctgaaactccctgctttccctatgggaaaggcctgggagactgatctgagtgtcacagggacattgggcaggggctagtattccaagctggtacacaccagcatggccatgctggtggttacaggaacaccaaaatacttctgcactgggttgactttatcagggtacttagcaaagaagaaaagtgggagctgagatccaggcagccttagcattccttgtaacaggccatgtggtctggcatagggctgcatcagctggaaaggcacttcctcttctcatttcacaagggcccatcttatcaccaagcagtatctgcctgaggagcattgttttaccagtctgcacagaaggaacgcagtctggagtaggatgagacatgccttggacaaaggttggctaactcctttagactttcaggacactggggaaggccgagtgtattaggcaagccagccattgtaaaaacaaccccctcatcttagtgactttgcacattacaagtttgcttgctcatggaacagtccattgtgggggtttgagtgggtatcctttcacacagcaactgggacacctaggctctttccctcctgtgcctttgctgtgccttgaagccttggagtcactaccagatcctcagcattgcctggcaggcgggccaagtgggggatagaaggggcccatcctagtgggccaggcctagatgcagcacccatcacttctgcccatgctccactggctggaactgagtcactggccttacctccatgcaagagaggcaacaggatgtgctttagccatgtgcccagctgcacaaggctaaagcacagccataactagcaactagataactagcaagtatctacaacagaaaaatgtcgcattctaagatgggatgcagttagcatttgggatgagatgatttttcgttatgtagaactgtctcatgcattgggggacatttagcatccctggaccttgaccatttaaatccatgagtgtgccctgtcatagtgacaaccccagatacctctatatatagccataggtcccttaggggtgtgatatagttggaaagtgacagaaactggcctgaggaacactcacatgagggtgtccacactgtagcactgatactgatgacaaggagaggctcctactctgagaaactgtacagagggtcacatctgacagggacagagacaatcttgggtagaacaatctacaccacagaggaccctgacagtctgggcaaggagacagccacaccctgtccagataaccctgctggcctgctggaggagatgtctacatgccacaggacctggccatctggaaggaggaggtggggaggtgtccacaccctgagggctcctgacagtgggcgggggaaggagtcctgataatctgcaggaagtccatgtcccacagtgaccccagtgacctggaggaagagcttgtgctctccacactctagaggacctggtggtctgacttaggaagtgttcacacccatgttgtcatgacaggaaaaagaagtgtcctcaccccagagggatccggacagcctggagatctagtctacacccaagggcaccctgacagtatcgggggaagtgtccatgccctcaatgtcctgacgctctggaggaagtgtccagaggttgaaggaacccaaactctctggaggagatgtccagaccccataggacccagacagtccaccgtcctaggggctgcacagagcaggaagtatctcagcctcactgtactggcatctggaggaaacactgtctaccacacagggtcctgacagtcgaggaggaagactacaccccaagggcagcctcagaccctcctgggcctgagacttttctggctgctcttccttagtgtcagtgtctttaatcctcccagggatcctctcagccctgtcctcacccttcctgctctccacacattcttgctgcactatttcctgaccgccctccagcaccctcagacccatgggtcctcctgatggtgccacaggcctccggaaagagccaaactcatcttcccgcattcccctctgaagagacagtatagcaaatggttaggagggtggactctggatcctgactgcccgaggctgaatcccagctccactactcatcagcaatcactaacctctgtgcctgcatttactatgtaaaatgggaacaataatagcactcacctcacaggcttgttacaaaaattaaatgagttactatgtatcaagcacttggaaaaagcacttgaacagtgttcagtacacagtaagtttgatacaaatgttatcagcatagttcaaacttcagcaaatccaaaatgtctggaagaccaagtttttttgtaacccatctggctacaggacccagcctgaccggatagggtcctatttgtagtttttatttatcctacttggggtaatagtcatacatttcgttgcagcagttctaatttacttgattctgtagtgccgtcccagatgctgccagggtgttacggaatcaagggcctatctgcacaccatgctatctactgtccttcttcagctgggacatgtactgacagtctgtaccaagagctccctccacgggagctgcccttccctcctttgcagcctcccacattgggtcagaactttcacgttcctgcagaacattcccatcctcacccaagagacaatgccagcctattttatccattctaaaacatgcattttcttcctattttaacatctcggaaatgaagatgtcttaattaaatcatggtgtatcatttataattaacagcagtttttcctttcttggtaaagggcacataaaattaagggtgtgccttacatttataactggtcctcataaccactcctaacattgctcactctcctatcagaaacaggaacacctttcacgtccatgatcttgtatggatctttacaacagcccctgtcaggttgggattttgtcactgtcattcccattctgcagatgagaaaactgaggcccagagaggtagaataacttgattaaaatcacaaaagtagtacaatggataaaaaaataaaggcccaaataatatctaaaactggtaccctgccaggctgtagctttttttttttttttttagctgaggaaacaggcacagagagaacattcaggatcccatatccaggagggggcagagcagcagctgactccaagtcttctagttcccattcacgtcagcaccctctcggaactgccagcttacagcctgtcttttccattcattctggagagctgttagggagcagagacaggcccatctgttcccaagctttcagggttgaccaatcattagagaatgggactgaaaagaagatgagaaggaaccaagaagtgtttgtgccctggagggcctgcagtatgactcactcctggtgagactgggagagcaggtagtggcagaataggcatgaagatggagactaggaaggatgtgggcactcctcctggctcaaggagggcctacggtgaaaaagatggctcataccccacccactaggcctgtgagcctgggagaggctgccctttgatcccaggacttgatcagacaagtggccagcttctgaggtaggggaggaacgggaagcttggaaggctgcctagagaggtcccatctgtttgagctgatgccacaaggaagactgttctccaggaggtgaagggagactgatcttgacatattccaccctcatgttgtggcccttaggagagagtccccactcttccaccaggtggtaaagcccttttatgatctgcaactcgttttagagaatccgtctcttctccattccccctcaagccctaagcactgtttcctgatcacagtcttacactgtgggtgtgtgaatctgtctctctgtgaccagactttgaccccttgagggcagggaccaatcctggttcctgtgtatcccctacccacctgtgacccctgagagtggaccgggcctggtccctgtgtctccctgatcagaccgtgagccctgcatgctgggactgggcacaaggaaggcctcaataaaaaccctggcaagggagccaggttcctcaaggaacagaactggagcacggggcagtgggtagtgtggcccgaggcagggtaaatcttggtttcctcaaggcattgttagtcagcctttggcatggaacacagccttgaggggacagccagggagaacaccagtgtggccatcctagctaaggagatggattcccaagtcagaagggcatggtcaccggcccacatgagggtgagcaaggaaggaagcccgagaggggtctctggagaagggaggggaaggaagaagtgtggcgggggagtactggagctacctggagggccgccacttggacagaggacaggctgctaagccaggaagcagaatcaaagtaaacagcagtccccatgtgtctcctgtgtgctgtgcactgttcttggctgaggtacagtgggacccctacccagggaagggcctggtcagctacgcttggggattggcaggaggctgccgttgctggcctcagggaagaggggccatggggccggagatttgttggcgtggattgggaggcaaggacaggctggggctaggatggcagcaaagcttcccatttcctaggacaggtagggaaccagctggggaggaggcacccactgccgtctgaagcaccagttggcactgcgcagccctgggccgagggagagcttctctcactgtgctctcccttcatctttcctcctcctctgctgctgtctctgaagtgtgtggcctcagcctctttctggctctctgaacctgggcctccctctgcctctgcctccacctctcttgtcttgaggcccttgccccctttccccatggcctgggtctcttcttcccctctctccacgccctccctgctgggtcctgcatgggctcaggctcccttgcctggatcagtaagtatctctccctgtggcaccctgggtcactttctttcttgcccttgctttggtctctcctgatcaccttcctgctccgtcccaaggcactggaggctccaggggttcttgggcagctcttgctgggtggcggcaggaggtgctcgcgtggccccagttgggccctgcagccaggccagcctgcactcaccgccagggactcctcctgctagccagaggcctgaggcgggccaggcagttgccagctgaggcccagctcctcaggaagggccgacagactctctgcgtcactgcccatgtgtgtccacgggcaggggtgcctcctgctccctgtccttcagaagtcaggagcagtgccggctttcctgagacttcgcggccaatctccccttacccatggccctttccctagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagtgtgggtacccccggcaggcgggcaaggggtcgagaggggcaggctggagcccctcctcactctcccaactgttctttctcgcccagtgtgaccccaacctgcaggtgtacaacgtcttcatagacaaccttgacgagcggctgccccgcatcgctttctttgccacaagaaccatccgggcaggcgaggagctcacctttgattacaacatgcaaggtgggggtggcaagggactgggggcaggggcgcactgtgacttgggacacaaggacccctcccaaaggcacaccagtcactcagagaaccaaggaaaattctttagcgggagctttaagatgctcttcctgactcccagtcccccattcggactactagacccctgcctacccctcgagtcccctcattcccagcccctgaaccctaaccctgaggcattcataccaacttctcccaagattcctggagagttaagaaactcctgactccagtcttgactgagtttccctcatcccccagcccctccccactcctagctccctttggccttcttcatcccaagcctctggacacccttgtggcctccagccagtcccctccttgataagctagccacctctgagaccctcaagggcaggtctttggcaggagagttcagatgtacctctggatgcccaggtggccctctattcctgcccctgcccccccccacacacctaaaacgaccctcctggttccttgacggctccctgcctcccccagcattcttcaacccctggcctgaacaacctccagtgctgagccctggccctagccccaaaccaccaaccctaagatctcccaactcaaatcccagagttgctcccagccccaaagatccttggtctcatggtataaagggtagtgggacccttcatccaggccttctaacaagtcccctgcctccttccctaccttcctccctccctccttctccccctccctccctgcctccttccctcctctcctccctggctgtgactccacagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaacaaaccaagatgtgaggtgcttgtgtgggtgggggttgaggggatagaggctgggagctgggtttgcccaggaacatgttcctcaaacctcagccatttgactctaatcctcacaatttcagcccccacagcatatcacttacaccatcatctatataacatcttgacctaaaataagtttgttttatacttaaactttaaaatgcacttaaggctgggtgtggtggctcacatctttaatcccagcactttgggaggccgaggcaggcagatcgcttgagctcaggaattcgagaccagcatgggcaacatggtgaaaccacgtctctgctaaaaatacaaaaattggccaggtgtgggggcatgtgcctgtacctgtagtcccagctactcaggagcctgaggtgggaagattgcttgagcctgggaggtggaggttgcagtgagctgagatctcaccactgcactccagcctgtctgtctccagaaaagagccaaaccctgtctcaaaacaatgcaattaaattgactggtttagactggccgtaactggttttgactggacttgaccgatcttgacctgtgttggccgactttgacttgtcatgactggctgtgactggtggtagctagccgtgactggcctcgactcgttttgaccaatcaggactggcttggactgggattgaccagttttgactgcttaaactggctgtgatcagcctggactggcttggattggcctggactagcagggactgaaatggattggttttgaccagctttgaccagccttgactggtcttggcctgctgtgactaacctggaccagctgtgactggctgtgaccataattgattagtttggactggccatgactggctttgacccatcctgaccagccatgaccagtggtttctggccttgaccagccatgatctctggtaactggccttgactggccgtgatcagctttgaccaacttagactagccataaccagctttgaccagtcttgactggccatgattggtggtgaccagccatgactggtaatgtctggctgagaccctgccacctcctgcctgaccaagtgcccaggcctcagggactatacagcactgggggggtgggggggagggtagaaggagtggagcaaagtggggagggagaaaaccaaatccactgctgtctaaatggaaaaaccataatcacttgccataagcaaacaaaaataaccagaggaatacatcaatggaaaggttaaaatgtgataatattctagctggaccttccctgctcttaaaggctttgaacccaaaatctgcctccagcattcaaaatgaaaagtttgtgtgtgctggggaaactttttctgcaaatatttattgagcacctatatggtgccagggtataaagtggagaatgaagaccacatttcagatatacttactcattttcatcatctctcaatctgaaagggagccagtgctctttgtttttgctcagggacctcacgtgccgtgacagatacccaaatatttcaaagacctcatacagaggtggcaggatcccaaaaagcccagagacctcatacacagggtaaccaggacatacacagggcatctagggtataaggccttatagaccatataccctgaatattgaccccaaacttctcagaaacctcataccctgggatacacacctacatatatctcagagctctcataattggacacaccgcaagtaacacaggcttcactgaaaactatgggctacagacccttaaacagctcttagacctcacatactgcctcatatactgggattcagaccttaaacacatcagagacctttcctttgatgacagagatgcacaaccatctcaaagaccttacaacttgagatgtcactacccaaactatttggaggctccacaccctgatcattgacttccaaaccgctcagagacttagtatcctgggacagacccccaaacaactgagctggcacaccctggacacagactgcccaaacacccgagatacctcgccctttgaaaacagatccttaaatggttctgaaaactcataccttgtatagggacccacagattgctcagagacaccctagaaaacagacaagtaaacatcccagagaccttacacgtgaatatagtgccacaaacaacttagactcaagtctttgaagcagaccccaagagcttagagatctcacagcctggaaacagaccctgctcacaggactcatacctgggaaacaaatctgtttacagctcaaacatgacctcacgccttctgacacagacccctcaacagttcaaagccaaggcagcctagtaatcaatatatttctattctattgataacagacaataccaaacacttcagagacctcacactttgtaaccccacacccaaagagctcagagacgtggaaatctgattacagacctccgggaaactcagagacttcacaatcagggataaagatccaccaatttctcagagaactcacaaactgggacaaaaatggaccaacagttcagagacctcacaacctcttctcagaccaccagacagcccagagacctcgcaccacggacacaatgctagagagccctaaaatcacttatgctggaacacaggcccgaaaactactcagaggctcacaccctggacacagattcctgttcagagatgtcatatactggacatagagttccccaaaatagctcacagcctttatacaccgagacagatccccaaacagctcagaggccccacagacctgaaagtgtggacataaaccctctatagagcttaaagacttcacaccctatgacaaaaaccctgaggaactgagatcacaccccctggacacggaccccaaacagcttagaaacctcatatcctaggctcagacccccaaacagttcggagtcttcccactctaaacgcagacctctaaatgcttaaggaatatcacatcctggactcagtcctcaaaaccattcatggaacttgccctttgtccttatccggaaagatttcagatggctgatagtcatggacacagatcaccaaacagctttgaaacctttgtgcaaagttggccacaaacagtagagacacttcataactggaacacagacccaaaacggcttaggacctcacattgtggacacaggctcccaaatgactcagagaacttctaacctgggagacagacatgaaaacagttcagagatatcacatcctggctaagtatgcccgcacagctcaagcacctcatattatgggacacaaaccctcaaagagttaacctcacaacctgaaaagtaaacccacaaacatgccaaagacctcacacagcagacagacaatgcaaaaatgctcagagttgacaaactttacaccctaggatacagaccccttaacagccgagtgacccagtgacatacaacccgggcatagacccccaaatactagagagacgtcagaaactgataacagaaccccaaactgctcagagaccccaaaccctagaaccagacccctaataagtcacagacctcataccctgggactgagactccctcaacaggaactgtctcactcttggaaacataacagttgagggacctcaacaccaaggaatacagagatcagagatctgacactttgggacacagagggtgaagcactccagaggcttgaaacagtaaaaagacattattagtacaaagacatcagactctggaaacagatcctgaaactgctcaggaaaatcaaccctaggacaaaacccacggcatcacagataactcatttgttgggacattggctcaaaacagtttggcggtgatactcaaatacatcagagttctcatacaagggtacaaacacctcacacctgaaaagagagactgctaaatagttcagagacatcatactctgcacaggaaccaccagagagttaagaaatttcacacctatagaccttcaaacaactcagaaaactcactcactggcgcacacacacccattacaagctcagagaccttaaccctggaacaaacccctaatgagtcagatatatcaaaccccgggactgagccctctgaaaaggaacagagacttcacgcctgaaaatatatcccaaacaggtcaagggactttgaaaccaaaagagctcagggaccacgtatcctaggacaccagtggacaaacagctcagagacctcacaaggtaaacacagtccgcaaaacagcccagtgaactcacccccctggaatgtagaccagaaaaagcgcagaaccctcgcattcaggattcagaatccttctgagacttagggtatagaccccaaaatatatttcagagaattaatatgctggatgcagagtatcaactaattcagaggcctcaaattgtgggacgtacacacccaaagagatcagagaactcacatcctggacatacaccaacaaacagaccagggacctcaaccctgtgacatgtgcgcgcgcgcgcgcacacacacacacacacacacacacacagctcagaaaatccaaattctaggaaacacacacccaaaaagaacggggacctcacatcctgtgacatactcacagaaagatcaaaaaccacacaagctgagatatacacccacaaatatttcagagaactaacatctggggccttatacccacaaacagatcacagaactcagtccctgagacatatacacataaaaataccagacacttcacatgccaggacatatacccatgaatagatcagagcactcacaccttgggaaataaaccaaagactacatcagggacctcacatattacttgaggcacacactcacaaagagaccagagactcaattcctgggacataaacccaaacacctcagagatctcgcatgctgggacaaagaaagaaagacaggtcagaacctcacaacctgggacacagagccacaaacagatcagagattacacactgttgacaaacatacaggaacagatcagaaccctcacatcctgagacatacaaccacaaggagatcagagagctcacatcttgacatacacccataaccaaactagacttgacattctggtacgctgaccctcaaagagatcagagaattcatacccttggacttacacccacaaataagtaatagaccttgcaggctagaaatacacatagagctagatggacggcctgtcatcctggaacataaacccaaaaagaggccagagaatttacgtcttgggacacacacccacagtcacaatagagacttcacatcctaaaatataaacccacaaaggatcagagatcataaaccaagggatatacacccacaaagggaacagatactgtccactgtgggatatacattgagaaagaccagagaaatgcacatcctaggaaatacactaaaaaatcctgggaaataaatccacagacagtaatgaaacactgggatatacaaacccacaaacagatcagagaccacacaccctgggacacatatccacagacagtatgagatttcacgtcctggaacaaacagcaagaaacaaatcagagacattaaacacttggcaatacatgtgaagagatcagagataacatagcctgggacactgacaaaatgttcacagacctcgcatgctaggaaatttgcccagaaaaagatcagaaacctcacatcctatgacacacaacctcaaatagatcacagacataaaatcctgcaaaacacacccacaaaccattcacaaatcttgcatcctggaacatacaatgacaaacaaatcagagacctcacatctaggggaggtcacacccataaagagaatacagataacagaccccgacacacacgcatacccagaaacatacagataactatcttacgaatatagctgcaaacagatcagagggctcacatcatgggatatacactgacaaaaggattagagaccttacaacgtggacatgcacccacacagatcagagacctccactccagcaacgtacatggacaaatggctcagagctctcacatcctggagcatacaaaaacaatcagagacttcaaatcctgcagtatacaaccataatccagtcacacttcatgtgctgaaaaacacacccagaaacagatggtagacatgacatcttacagcataactcccaagagatcagatgattcaacagttttggcttcaaatttctctctgacctctgcttctgtcatcgcatcaccttctgtgactctacttctgttgtcacatggtcctctctgatgtgacacacacagtcttctcagaccctgaaggtcctaccttcctcatataaagactcttgtgatgacagtgggcccacctggattgtccaggataactgcccccatctcaggatgcttacctaatatgtatttgcaaagccccctttccagataagacaacatattaacaagctccaggaatgaggtgaggacatatttggggatctattatctgacgaaacagaacatacatgcacaaagagaaccctcacatcccgggactttcacccatgaactgctcacagatctcacagctggagtcatagacctccaaagggatcggagaactcccactcctggacatcaatccaaaaagatcagagagccacacactctggggcatacgccaaatgatgctcatagtcctcacaccctggggattaaacccacaaagacataagagaaccacactctgccaagtacattctcaaagagaaccggaacctgacacgctgggatatacactagcgaagagatcagggaccccacattctgggacaaacaccctcgaacataccagatctctgactctgagacacagacacaaagaacacaaaaaaacacattcattgacagacacccacagacaggtcaggaacctcacaaactggacataaaaccacaaaaagaatgggactcacaccctctataaacaccctgaggagatgacacactcacatacgatgacacacacgaacaaatggatcagagacctatctgagaacctatctgagaaacacaaccagaaaccataccagagacctctaataccacgacatgaaacaccaggtcacaggcctcatatgcagaaaatactcctgaagaagtacagagacctgctgtctttggtatagacccaagaggagatcacaggtctcccacagagtgctccaaaaccacattgtggatacatgtaccacaacaaaacctgacttctactataaataccagcacacaaaccagaaactttatatgcatatcataagtacccacaaatattggcaaaacagctcagaaaattcatgccagggatatatacccacaaacagatcaaagacctcatatcctaggctaagcattcagaatcagatcagagaactcacttcctgagagaaccctctcaaagaggtgagaggctgggcgcggtagctcacgcctataatcccagcactttgggaggccaaggtgggcggatcacctgaggtcaggagttcgagaccagcctggtcaacatggcaaaacctcatctctactaaaaatacaaaaattatccaggcatagtagcacgggcctgtggtcccagctacttgggaggctgaggcaggagaattgcttgaacctgggcggcagcagttgcagtgagccaagatcgcaccactgcactccagcctgggcaacagagtgagactccatctcaaaaacaaacaaaaaaaaagaggtgagagacctcactctctgcttcattcaccagcagacataccagaggcttcacaccatgacacagagacagacaaatcagggagtctcacatcttgggacataaacccagaaacagggcaagaatttcaagcaaaaggaaatatactcacacagagcttggaatccttacaccctagacatacgcacctcaacagatcagagaactcacacactggcacatgtacacaaaatcagattggagatgtcccatcctagaacatacgctcctccacaaaagctgagagcacaaattctgggacacacaccaccaaataggtcatcagatcagagaccctgcacagaaatcagtgacctccactatcagacacacaccctcacaaatagatcatgaagttcacatcctgacaaccagatagagacagcacaacctgacacactattgattttctattgctgctgaaacaaatcactaaaagctttttgtcataaaacaatgcaaatttattatctcactcagctgggggtggctcatacctgtaatcccagccttttgggaggctgaggtaggtggatcccttgagccgaggagtttgagaccagcctggccaacatggcaaaacctcgtctctactaaaaatacaaaaataagccgggagtggtggcgggcgcctgtagtcccagctactcgggaggctgaggtacgaaaatcgcttgagcctgggaggcagaggttgcagtgagccaagatggcaccactgcactccaacctaggtgacagagtgagactctgtctcaaaaaaataaaaataaaaaaaaacttatgatcttacatttctgacaaagagtcttacagggtaaaagtcaaggtgttggcagagctgacttctttctggagttccttggggagaatccaatttcttttttctttttcttctttctttcttttttttgagacagagtcttgctctgtcgccaggctggagtgcagtggcgcgatcttggctcactgcaacctccgactccctgattcaagcgattctactgcctcagcctcccgagtagctgggattacaggcacgcgccaccacacccagctaatttttgtatttttagtagagacaggttttcaccatgtcggccaggatggtcttgatctcctgacctcgtgatccacccaccttggcctcctaaagtactgggattacaggcgtgggccaccacgcctggccaaagaatccagtctctgtaggctgcctacatttctgagctcatggcctcttcctccatcttcaaagccagaggtctgtttcaccttcaaatctttctctctctctctgtctctctccccacccccctttcttcctcctcccccatctgtctctccttgtatccatctatctctagctctctttgatctctgtatatgttgtccatcatcttttctgtacttccatcactacatagccctctctgactcttgccttcacgcctccctcatataaggacacctgtgattacattgggcctgcccagttaatctaggataagcatccccatctcaggatgcttaacttccacaaagtcacctctgcaaagtccctcacaatcacctctgcaaagtccccctttccatgtaaattagcataattgtaggtttcagggattaggaagtgcacatctttggggtaccattagctaccagagacctacatacacacacaaacaattcacagactttacatcctgagtcatacacttccaaatagataagacacctccactctctaacagacatccaaaaagagcagagacacattctgggacatataccaaaaaatactcagagtcttcaatcacttggaattaaactcacaaacacataagagaactcaccatctgggacatacacactcaaagaaaacatggacctgacatgataggatatatacccacgaagatatcaggggccccacatgctgcaaaatgcacccccaacagatcaaatctccaaacctgggacatacacacacacacacacacacacacacacacacacacacacacacacactgcagaaagaaacattctcagacataaacccactaccaggttaggtatcttacaatccgggacatgttgaattagacctcacatccttgacaaatacacacaaaagagacactcacatactgtgacattcactagcaaacagatcacagacctcatgtaagaaacacaaccaaaaagagatcagagaccttgaatcctgcaacatgaaactacaaacagcctagagaccttacctgcaggatatatatgcagaataggtatacagacctgacatcttgagacataaagccacaaacagatcagagacctcacaacctgagctagatacccataaacaaatcagaggtctcaatcctgcaatacagacccataatcaagccatagacctcacatgctagggaaaagagccagaaatagatcacagacctgaaatcttgcaacatacacccataaagagatcagagagcttatattctgagacatactcccaaataggtcagaggttttcaaaccaagggaaataacccacaaatagctcaataacttcacagcttggacacatacacacctcaacaaatcaggtatatatattatacacacacacacacacacaatatatatatatgttatatctactatcagccctcggattcaaccaagtctggatcaaaaacactgaggaaaaaaataatttaaaaacatagtaaaaataatacaaataaaaacaatgtagtataacaactacttacgtagcattgtatcaggtattataagaaatcttgagattatctaaagtatacagaagaatttacataggttacatgcaaataccataccattttatataagggacttgagtgttcacggattttagtatccacaggggtcctggaaccaattcctccaacccacagatactgagggacagctatattgttacatatatatatgaatatatatgtcagcatataaatcacatatgcttggaaatataactaaaaaaaaacttcagaggtctgataacctagaacattagaacatgtatgccccaacagctcagagaactcacatcctgggatgtacatccataaagagctcaaagatcaaacatctcatagggcatgcttttacaaatagatcagaaaattcagatcctatgttaaaaccctcaacaaaggtcaaagacttcacacagtggttcattcaccagtgaacacatcagacatttcacaccatcagacaccacccacaaacagatcagggaattaacatcctgagacatataccaacagatcagagacataacaacctggacatgtatccacgaacatcagaggcttcaggccacgggacctgaaaccacaaagggttcacaaactttcttccctggacacacatactcaactagatcagagatcactcatcctgggacatgaatccagaaatagaccagagaattcatattctgggacacataccctcaaagaggttaaagaccttccaccctggttcattctcctgcaaacagatcacagaattcacatcagatacacccctacgtgtatatcagggagttcacatcctggcacatatactgacaaatagataacagacctcacaacatggacacgtaaccacaaacagatcagagaccccaaataccaaaaatagcgcagagccctcagattatgtgccattcagcatcaaacaggtcagggagctgaaatcctgggatatgcacccacaaacagagtagaggccttacaacctgtacatgaacccacaaagagaccacagacatcaaactctgcaacacaatccacaaacagatcagaaacctcaggccctgagtcatatataacaaactgatcagaaagttcacatcctgggatatactccacaagcaatgcacagaccatacactcctgagacacacacccacaaacagagatctcaaatccttcaatgtacaactccaatgaagtcagagacctcacaggttaggaaaacaccagaaatagacccgacatctcataacacagaaccacgagcagatcagagagctcatggactgggacatttctttaccagtaagcagatcagtggcctcaatcctgagacatacatccacaaagagctcagaaacctcacaccctagacaaataaacctaaacagaccagacacctaacaacctaacatcctggtacatatgtaaccaaacaaatcagaaacctcatgtcacaggaaataccccccaaacagatgacagacgtaacaacctggaacataatccttaaatatctcaaagacttcacctactggaatgtactcccaaaaatcagctcaaagatgtcacatcctagtacatgcacacacaaacagctcagagaccacggattctgggacacacaccctcaacattcagagacctctcaatgtggttcatacaactgcacacagatcagagacttccaccatcagacatacactcacaaacagatcatggagttcacatcctgggatgtgtaccaataaacagagatcaatgtgtaacaaatcgtaatcataatgtcataaaacaacacacatttattatcttacttttctgcaggtcagaagaaaaaaatgggtttcaaagggctaaaatcacagtgtcagcagagctgcattactcctggaggctctaggggagaatctgtgcccttgccttttccagtttctagagctgcttgcgttccttggcttgtggccccttcctccaccttcaaagctaggagcatttcatcttcaaatctctatctctctgatatctgcttctggcatcacatctgcttctctgactcggactgtccagcctctctcctctaaggacccttgtgattacactgggctcacctgggaaatccagaaccgtccccgcatctcaagatgattacttaatcacatttgcaaggaccctttaacatgtaaggtcacagtcacacattccagggatataaggatgggaaccttcactccaccaacctaagatatacatctacaagcaatgaaaaacatcatttgctgaggtatccacacataagcaactcaaagactccacctcctatgttatataattccaaagggatcagagacctcctcccacctttggacatgcatccaagaaagaagtgaagcacatgttctgtgtcatatacccacaaagagggtggggacttcacacactgggacatataatcacaaacagaagatacttcacacccttgacaaacacacatgaggagattagaaacttaaatactgcaatataaaggcaaaagcagaatggaggcctcatctgagaaatacacccacaaggagatgagagaccacaattcctgcaatacattactcacaaacagatcagagacctcacactccaagacatccacaaacagaacagagatctcaacctgtaacatacacccacaatcaaagaagagatctcacattctagaacaaacagccagagactgagtatacacctgacatcttcagaatacacccacagagaattcagagttcatatccttgggatataaacccacaaaaatatcagagacctcaagccatgcataatgtagtcacaatatttattgtgaatggtatattgtgaaatataccataatataatatatattgttactacacaatataatacaatatataatatattatggtatattatatataaatataatatatactatatagttatctgttcatgttaatatgttaacatattatatatactattatgtatatataatatatacttaacatatgcttatatgttaatatattgatatgatataatatcatataataattataatgcacaattataaatattgtgaacatatacattatatattatataggttattatatatattattattacctcagagatctcacttactggaacatacactccaaatcagccaagagacctcacattctaggacattcacccacaaacaggtcagagacctcatatcctgagactacctgcagaaacctcagagaacacaaactgagggatagacaccctcagacaggtcagagacctcctccctggttcatacacccacacacagatgaaagatctgccacataagacacgcactcggcggggcgtggtgcctcacacctgtaatctcagcactttgggaggccgaggcaggtggatcacctgaggtcaggagttcgagaccagcctgatcaacatggtgaaaccctgtcctctactaaaaatacaaaaattagccaggcgtggtggcacatgcctgtaatcccagctactggggaagctgaggcagaagaatcacttgaacccaggaggcggaggttgcagtgagccgatatcgtgccactgcactccaacctgggcgacagagcaagactccatctcaaaaataaataaataagtaaataaataaaagacatgcactcacaaacagattggggattcacatcttgcactaacaaccagacagagacatcatgcacctgggacacagtattcatttcttattgttgtaacaaatcaccacaatcttagtgctgtgaaaaacacaaatttatttattatattacatctgtgtagggcagaaacccaagaatgggccttagggtactaaagtcaggtgtcaacagagctgtcttctttctggagactctaaggaagagcacgtttctttgccttttctgggttctagagctgcctgcagtccttcatcccttccccctttctccatcttcacagcggacagcagttcatcttcaaaatgctctctgatgtctacctctgttgtggcatctcctttttgactccgcttccaccatcacattcccttccatcatttagggctccctggtcatatctctttcactggacatctttgagggatgctttattcagccaaccacagactggtgtgcacaaacaattagagatttcacctcctgggatatactcccatgaacagcgcaaggacttcatgagctgggacccacacccccaacacttgtgtcatcatatcgctgtctctgactcagtctgtgtcattatattcagtgaaaatccaagaaaatctcccgatctcaagatgcttaatttaatcacatctgcaaggtaccttttaaaaaaaatttttttttttgagatggagtctcactctgtcacccaggttggagtgcagtggcaccatctctgctcactgcaacctccacttcccgggttcaagcgattctctctcctgcttcagcctcccgagtggctgggattataggcgtgcaccaccatgcccatctaatttttgtattttttgtagagacagggtttcaccatgttggccaggctggtctcgaactcctgacctcaagtgatccgcccacctcagccttcctaagtgctgggaatacaggcatgagccactgcgcctggcctttcaaaaatgtttttaataaacatttttaaaataatttaatcttaaaaaaattttctggaacacttcacgaatttgcatgtcatccttgcacaggcgccatactaatcttctgtgtatcattctaattttagtatatgtgctgctgaagcaaacacttaaatttttatatatttagatataaatttttatagatttaggtgtacaagtacagttatgttacatggctatcttgtgtagtggtgaagtctgggcttttagtgtacctaccaccggaataatgtactctgtatacaataggcagtatttcatccctcacccctttcccaccctcacatcttttggagtctccggtgtctattattctactctgtatatccatgtgtacccactgtttagttcccacttataagtgagaacatgcagtttttgactttctgtttcagtcattttacttaggataatggcctccagctccatccatgctgtttgcaaggtaccttttagcatgtaaagtcacatcacagtttccaaagattaggacatgggcatcttcgggggccttaagtcaacacaacaaaaacatacatgcacaaacaatgggagacttcacacacttccagaaagctcagagacctgaaatgctgggacacacaccacaaacagctcacttacctcatcctgagttatacatctagaaagtgatcacacacctcctaccttgagacatacatctaaagagcgagcagacacacacgtgttctgggacatacacccacaaacagttctgggatctcacaaattgggacatacacccacaaacagaacagacctcatacccttgataagcaagcaaaagagacttttttttttttttcagacagggtctcactctgttacccaggctggagtgcagtggcatgataaagactcactgcagcctcgaactcccaggctcaggcagatcctctcaccttagcctccccaatagctgggactacagatgcgccaccaagcctggctaattttttattttttgtacagacgggggtctcactatgttgcccaggctggtctcaaactcctgggctcaagtgatccttctacctcagcctcccaaagtgctcggattataggtgtgagccgccatgcccagccgaggtttttttttttaaactcacatactgtaacatacacacacaaatagatcagagacttcatctgagaaatataaccaaaatggatcaggtctaaaatcctgcaacaagaacccacaacatgttagcgatctcacatcctggcaaatacacactcagaataattaaaaatacttgatatcttggggtacacacccacaaagagatgagagagctacgatcctgggacatatacctgcaaacagatcaaaagcctcgaccctgagacatacaccaacaaagagctcagaaacctcataccctggatgtatacactgtaacaaataatacgccttgcaacctgttatgtatatgagcatacaaatcagaaatctcatatgcttgtaaataatgccaaaagcctaagatatctaccaacctgggatgtatatccataaatggctgagaaaactcacacctgggatatatatccacaaatagccctgggacatcacatcctaggatatgtattcggaaacattagggaactcgcattctgaaaaaactccttcaaggatgtctgacttatctcaacccggttcatttaccagaaaacagatcagaatcttcacaccattaggcatacacctacaaaaaaaaaagatcagggatatacatcagcaaacagattagagacctcataacttagacacgtaaccacacagagaccacaggcctcaaacccggcaacatatacccataaagataccagagacggccgggcgtggtggctcacgcctgtaatcccagcactttgggaggccgaggtgggtggatcatttgaggtcaggagttgaagatcagcctggccaacatggtgaaaccccacctctactaaaaatgcaaaaattagccaggcatggtggcgggcacctgtagtcccagctacttgggaggctgaggcaggagaatcactagaatccgggaggtggcggttgcagtgagctgagattgtgccactgcactccagcctgggtgacagatcaagactgtgtctcaaaaaaaaaaaaaaagatatcagagacctcacactcttgagatgtacaccaacaaacagataagggagctcatattatgggatatactccaaaacacatcagagactatatatgaccagggatcctaaattctgcaacatacacttacaagcacatcagaaaccagacatgctatgaaaaaaagtcagaaatagatcatagatctcataacctgtgacatacacccacaaagagatcatagagctcatatccaggaacaggaacccacatgtacccacaaagagatcagaggattcagaccaaaagatatacattcactacgggctctttgaaaccccacacgctggacattcacaactaaacagattatattaggtacatccagaacatatatagaaacatgtgagagtcctcaaagcttggtatgtatatgcataaagaactaaggctgggtgcggtggctcacacctgtaatcccagcattttaaaagggaggctgaggcaggaagattacttgagatcaggcgctcaagaccagcctggtcaacatgcacaaacatgcccgtctctactaacaatacaaaaattggccgggtatggtggtgcatgcttgtaatcccagctacacaggaggctgaggcaggagaatcgcttgaacccagaaggcagaggctgcagtgagtcgagatcgcgccactgcactccagcctgggcgacagagcgagacgccatcttaaataaataaataaataaataaaaattaaattctgcagtatataccacaaacagatcagagacttcacatactgggaaatcaactcagaaatgaatcagtcctctcaaattgtgacataccacccaaaagagacaggagagttcatatccttgggaataaacctgtaaaaaaaaaataggggcctcaaatcacagaacatacactgtcacacagttgagagacctcatgtttggaaacacactgaggaatagatgaaatacctcacacatcctcgaaaagatcagacattacatcatgggacatacacctgcaaacagattgatgatgccaaactgtaggaattaaatccacaaactgatcagagacctaatatgcagggacatataatcacaaatagatcagagaccttacattttttacatgcacccatgaaaaagatctcacataccaggatacacaatgatacaacgatagccacggacctcacacacaacaagaaaaaggtcataagccttatatcctagtaaataaacccccaaccagctcaggaacctctcactgtgggacatactccacaaacagataagagaactcatacctaggttcatacaatcacaatcatatcagagaacttctattcttagcatatacccatgaaagatgcttcacatactgataattacaatgacaaacacatcacagacctaaaatcctgggacatacatgcacaaacacagatcagatcagtgacctcacacactgggacatacatccacaaacatgtcagagatcttctattctagtaaatacatctacaaacatgtcagagacctcaacctcacatcctgggacatacttgcagaaatagcccagatacctaaaatttctgcataaaccatcccttaatttgcatgtaactaaaaggtgggcataaatatgactgcagaacggcctctgagctgctactttgggcatactgcctatgggtagctcttctctgcaaggagcagcacatctgctcctgctatacactgccgcttcaataaaagctgctatttaacaccaccagctcactcttgaattccttcctaggcaaagccaagaaccctcctgagctaagcctcaactttggggcttgcctgtcctgcaaccagatgaaagatctcaaactcagtgtatccatgaacagatcagagaccttacatacagagacatatgtgggcacatggatcagagacttcttacttgggaacatacatccagaaacagaccagagacctcatatcctgagaaatacaccaacaaactgactttgacatacaccaatgaaaatcacatactagtatacagcaacaaatggatcagagacctcacatcctgggaaatataccaccaaacaaatcagacatctcacacctctgcatatataccatcaaagagctcagagacttcacaccatgggacttacacacccaaaaagatcagatacttaaatcctagctcatataaccacaaacatacttgagaactcactctgagcaatccacccccaaacagattagaaacctcatatcctggaacatatagccacaaaaatatcagagacttcatacccttgacacttcacatatacaggaacatatacagggataaacagatctgagaccttacatgcacccactaggagctcagggaactcacatcctgggaaatatacccacaaacattttggagacctcatacccagagatgtacacccacagtcatagcagagacctcatgccctaggacatacaccctcagacagaatagtcctcatattctccaacacacaccaaataaacagattaaagtactgacatccctaaaaaaatacaaccagaaaagctcagaaatataacatctagggaaatatagccacaaaaagctgagactcacaccttggcacatacacccacaaagagatcagagatctaacattccgggacataaaaccaaaaacagatcagagacctcaaacccttgacatgcattcatgaagagagacctcacatcttgtcattgtataatgacaagcagatcagaggcctcataccctgggatgaatactcacaagcacattggaaaccttacaccattggacatatacccacaaacagaacggaaacctcaaatatacttccaaatggatcacagaactcacatcttggaatatatacccacaaaaaaatcagaaatctcttattctgggaaatatagactcaaacagattagagaccccacaactttggacacacacgatcaaagggctcagataccttacaccctggtatatacacccatgaacagagatctcatatactgtgacataaatgtcagggatactcacaaacagtttgggagccttacatcctgagatatatactcataaacagtgcagagtactgattccctctgccctcaaactcagaaatatcaaagtcgggacacaggttctcaaacacattaaagacttcatatccagggactcagtggcccaaacagctgacacctagtgttctggatgcagaatccagtcaccttggtgatgtctcttcctgggacttagaaatccatatacctcaaagaataaacagaaacaatacaccgtcctccaaagagtgcatggatgtgaacctgggacacagactgccaaacaccccagtgacctcatacccagaacagactgccagagagctcagataattcaaattctggacttgatcacgttctgaacatgaacagaaaaaaacagcccagaatccccatgctttgggacatagattcccaaataattcagagatctaaaaacctagagagagaaccccaaaaggtcacttaaaaatgcgaaacatagaatgcccaaaagacccagacatcatggcatggatacagaccacgaaaaagctccaaagtctcgaactccagacagaccatcaaagagctcagaaacacctcttatgagttatctattgccacataaaaaataacccccaaatttaccggcttttggctgcttgagcatcctcgaatgatggctggcttctactagtcagtgatccaagaaaaagtacagcagaagccataagtgccttttaaatttccctctaggtaagtactgctttgctgcatcccacaaatttggtaagttttattttgattttcatttagtccaaactattttttatttctcttgagactactttgagctactggggccctgcatcctcccctaaagtctttctctggagctcataccctgcctctcacataaatgtataaacccgtctcataagcacagttttcagaagaggaacaaagttttttctcactgtgcatccttgcctcatggtgcacaatctattatgcatgttctcaagagaacaactgaagtaaaactgtggatttactagagatgaagacacaattctggggagtgtttactctttcttaaacccaacatacatttacattaaacaacatgtgcacatgattcctaagttccaactgagacagtcccaagcccacactggcccctggcatttatatggattgcttgcttcccttcccccagccctgaattctactttcagaaggggtgtgggattagggggaagggactgaaatcaggagagcgtgtgtggactgtgcattgtcctaccgattcttaccagtcttgtaaaaacctcagcagctcaaggtttagatgatccaaaacgctagactctcctaccatccaaccaggacttgggggttccaggctttgaaagagggtctatcaggctccaaagtccatgtgttctgggttatcatcagtgtgatcaaagcctaaggggagatggactccaacatccatctgagcaacgtccatcctgagagatgggggtccccactcagtggctgatgtcaggagacacagaacaaacatctccctacaacacaatctccacaaacagtgtcaagggaaactgtgccctccagaacagagggcgagataggttctgaaggaagttggtaatttatactttatggtctaggccaagcttgtccaacccaaggcccatgggccacatgcagcccaggacggctttgaatgtggcccaacacaaattcgtaaactttcttaaaacattatgagatgttttggcgatttttttttttagctcatcagctatcgttagtgttagctattttatgtgtggcccaagacaattattcttccaatgtggcccagggaagcctgctggtctagacaaagaggctgggattgctgtgaatcccgatcctaatgtgtactggaggagttcacaaccaattgtggggttcctacttctcaccacctttctttttctttttctttattttggagacagagtcttggtctgtcgcccaggagtgcagtggtgcgatctcggctcactgcaacctcagcctcccaagtagttgggattacaggcatgcaccaccatacccggctaatttttgtatttttagtagagacggggttttgtcatgttggccaggctggtctcaaactcctgacctcaagtgatccacccaccttggcctcccaaatgctgggattataggcgtgagccaccacacccaaccctcactgcctttctgaactggcatatggtccaggcagagggaaaaggagatgtcacacatacctcatgtctggatttggtatgtgaaaaggtcactaattcctgatatagcaccccgaaagagctcagagctttcaaaccttggaacagaaaccgtaatacagaccacagacctcacactctgagacacagacccaaacacctctcagagaacataaacctcagacaaagacccctaaattgttcaaacgcttcataccccacagaccagtggttctcaaccagaggcgattctgccccgcaaagaacatttggcaatatctaaggacattttggctgtcacaaatatgtgttgcgggcgtgctactgtcatctgtgagttgaagccagggatacagcttgccagtgtcctttagccaaagacccccgccccacccaggaacatacctgtagtggaacaagttgggatgattactcattgcagtgagggagaacgcactccatggggaagtgtggggtggtcgggtttgattgagtgatttgggggtagggtctaaggaagtgggggctcactctagattagatgctgtcagaaaacaagggcaattttacaattgggtatttcaataaatcttatctatagggagggcagactagagtgaggctaacgctgtcattggtaaggaagtggcagtcactcattttaaccaagagaggagaatgtttagtattttatgggcaacacagtgaatccttatttttgtttgtgcttaaacaacattataaagtggctgtgctctattttattattttattattattattattattattatttttattttgagacacagtctcgctccgtcacccaggctggagtgcagtggcgcgatcttggctcactgcaagctctgcctcccgggttcacgccattctcctgcctcagcctcccgagtagctgggactacaggtgcccgctaccacgctcggctaattttttgtatttttagtagaggcggggtttcaccgtgttagccaggatggtctcgatctcctgacctcgtgatctgcccgcctcggcctgccaaagtgctgggattacaggcgtaagccactgcacccggcctattttattatttttttgagacaagttctcactttatccccaggctgtagtgcagtgtggcatgatctcggctcactgcaacctcaaatgcctgggttcaagcaatcctctggcctcagtccctcaagtagctgggattacaggcacccaccaccatgcccgactaatttttgtattttttgtagagacggggtttcaccatgttgtccaggctggtctcgaactcctgagctcaagcgatcggcccacctcaaccccccaaagtgctagtattacaggcgtgagccacctcatccggccaagctctgtcgattttatcatggtctcagactaaccttacctgacgctggtattctgtgagattgttcacgtccgttaggagaataacatggcctacctatgggggccgggcctgcttctgggtgtcagaggctgctcccttcttccctccctttttctctcatgctaaacgtctcttatgggtgaaattatgtcccctcaaaattcctacgttgaagtcctaaaccccagtacctcagaatgtgaccttatttggaaatagggttgttgcagatgtaattagttaagttagagatcatgctggagtagagtgggcccctaatcctgcgccactggtgtctttataaaaagcggaaatttggacacaagacacacagggagaatgcaaggtaaagatgaaagcagagatggggtgatgcagcagacaccagggaacagcaaagattgccagcaggcatgagaagctaggaaagatgcagggcacacattcccctcataggccccaaaggaaccaaccctgccaacatcttgatctcacacttccagcctccagaattgtgagacaatacatttctgctatttaagttacccagattgtggtactttgtcatgacagcagccctagtaaacaaatacaatagaccctacaatgcacagaacagccctccataacaaagaattttctggtccaaaatgtcaacagtcccaaggctgaggaaccctgccctggatacagaaccgaaaagtttttattgacctcattatctctgatagaagacaataaaaaccagctgacagtatacacatctttgaacatagtccttcaaagtgctcagaaacctcacaccttgaacatggaagcccatacagcccagagaagacaagcctaaagagactactaacaggtcaaagacatcatactctgggacaaagactaccaagatgacgaaagacctagcatctaaaaacatataccaaatgttcagagacatcacatcatgagacacaaaacccaagagagctctgggtccaaagagctcagatatttcacaccctggacacaaaccggtgaacaacagctcataaataaccgtgtcattcatttcctgattttaaaaattgtactaagattatataagtaagcattaggagaaaaagagtatataagaactctctgcactatttttataatttttttaagtctaaaatgcttttaaaatttaaaaaatgttaaaggctggacgcagtggctcacatctgtaatcccagcactttcagaggctgaggtgggtagatcgcttgagctcagaagttggagaccggcctgggcaatatggtgaaaccccttctctacaaaaatacaaaaattagccaagggtggtggtacacacctgtattcccagctacttgggaggctgaggtgggaggattgcttgagcccaggaggtcgatgctgcagtgagccatgatcacgccagtacactccagcctgggtgacaaagcaagaccctgtgtccaaaaaataaaataaaataaaaattttaacaaaaatgatcacaggacgtaaaagggaatttagaaaacttaaataaggccaagtgcagtggctcatgcctgtaatcccagcactttgggagggtaagacaggagtccaggagttcgtgaccagcctgggcaacatggtgagacgtggtctttacaaaaaataaaaaaattagtggagtgtggtggcacatgcctgtggtctcagctactcaagatcaggaggctgaggtgggaggactgcttgagcccaggaggtcgaggctgcagtgagccatgtgcatgccactgtactcagcctgggcaacatagtgagaccctgtctcaaaacaaaacaaaacaaaacttagatacatcttgccaacaagcacagaaaacaatgttaagcccttctagcagtcacagaaatgccaataaaagaaaaatgaaaatcaattttaagaaaaaaaaaaaaaggctgagtgtggtggctcacatctgtaatcccaacactttgagaggctgagtcaggagtatcatttgagcccaggagtttgagaccagcctaggaaacagagggagaccctgtctccacacgcaaaaaaaattattttgggacagggtcttgctctgttgcccaggctggagtgctgtggtgagatcacagttcactgcagccttgacctcctgagtagctggggacaacagacacgtgtcaccatacccggctaatttttttttttttgtagagatagggtttcaccatgttggccaggctggtctcgaactcctgggctcaagggatccacccactttggcctcccaaagtgctgggattacaggtgtgagccaccgtgcccagcctacaagaaaaaaaaaaaatagccgggccaagtgtggtggtacgcacctgtggtcccagctactcaggaggctaaggtgggaggattgtttgagccagaggtcgaggctgaagtgagccatgattgcaccactgcactccagcctgggcaacagagagagaccctgcccctaaaaacatacaaaaaggcctgggcaacatagtaaaatcccacctccacaaaaaataaagaaagttagccgggtgtggtggcacgtgtctgtagtcccagctactcaggaggctgaggtgagagaatcacctgagattggcaagttgaggctgcagtgagccgagatcacaccactgcactccagcctgggtgacagagcaagatcctgtctcaaaaataaataaataaaagtaaagacacacaaaaaaagaaaagaaaaaaaaactctgcacatccggggacaaagatccataaacagcttagaaaccttgggacattctggaccaacgtaaacagaaaaacagaaaagaaaaacaaaaaaaaacaaaaaaaaaagaaagaaaaaagaaaccaaccctgggacagagacccacaaagatctcaaacacctaaacctctgagacacagattttcaaacagcaaagagacttcacagtctttttataagtcataccctgaactgagattccaaaacaaatcagacttcacatcctgcacacagtcctccaaactgcagagtgttgtaataactaccctatgatgagctgacttgacttgagaatcactttcttcctactacctacctacctcaccagccaaacacctcccctgtctgatgtttaaaatcccatcatttaaaagcgtactcttttaagtcttgcccccaccttccaaaattctccttgtagttgccacaagctcttcagcatcccagagcgtgaaaccatgcatctctcttttagtcacttatagcccaccccatcacactcctagtcaggcctggtcctgagggaagcctccaaatcaccctcttctgggagatgggggctggcctggaggaggatcatgagatcaccttgaatcttatctgctggactcagacctacaggtagcctgaaagacaaatgccagggaccctgaagaatttttcttagtgctgttgtgaacggtgagtgggtcctgaaatcaatataatgggatgcaataggcattgcttaaaaaaagaaagaataggtaaaagaaaatggaaaagattacccgacacactctgtgccagcccttgagtacaagccaataatgccagcttcttttacaggtgcacaagttgaacttcccagacgggattcgaacctacgatctccagtagccaaagccctgcctcggcaaccctgaacgccaacccaggagccaaagcgcttgcgccgaaacagcagccaataggaacgcggagccgaaggacccggcctgtagcctcttagtgattccggaaaacctcggtaccctggaagagcttaggtaggcagtctcgcggtgaccaatcagagctcagggcaagactttgtcccgccctacgcaactcgtccaggaagcaatcgccgctccgcggccttcctcctcaccccacccccggagttgattcgcatctgtatagccaacccggcgggaacggatatattaataaaagcttggtggcggcggcttccagacaggtggacgctttaggccgaagatcgggtccgcccggcgcgggggtcggtccaggcagagccattctctcctcggtctagggtggaggccgatccactcgcgggatgaggagacctttcgtgtctccactagtacaatggtatcttccgaaatacacgacccctcccctgtggtacctcccatgaccgtagtggtatggtcctggagctgcacagtctagtcgttaacccttcattcccaccgctcacgctccccttgtgtgtgcgacaaggactctttcatgtcagtgtcaagtgaatcaatcttcagttcaccgcaaaagaactaaatggactctttcatgccttcctcctgcccacgttccagccctgtctcccccaaccgacgtcccccagagcactgtccctgccccataccctgatgattcgtttgagagcaaaggcccaagcgtccaaacccttgctgcagagccaccgcccattaatgggcattcattcccgaggccactgatggaagtctgcctttgtgtggcagcatttatcaaaataaaaagcagacacccctccttactggaatgtcaccaccacgaaggtagggagggatatgtgtatttctagaccccccaaagtctctgcctgaaactgccctgcacacagtaggtgctcaaaaggggatttgttgaataaatgactcctttggcgtggcagtttcacttttaagtatgtgttctaaggaaataatcatacatacgtgcacagtcctgtgtgcacaagaatggaaggagcaaacaactaagggagaaaacggcaaatgcttaaaggcgattataccatagagtaccagctggctgtgaaacagaatgagacctcattactggaaacacccagatagctcagggagttcacatcattgcacacagagcacaaaagagctcagagatctcacaccgtgggatacagagtccaaaacagttcagggaactcacactgaacacagaccacaaaacaaaattagagaactcaataatggaacatatcttaatagattcccagtcatttcataggtctcatcctcgtcacaaaatcctacaaacatttcagagacctcaccctgggacacaaaggccgaaacacctcagggacgttgcacgctgggaaaacaaatcccaaacaccttacatacctcatatcctggacgcagactccaaaacagctcggagacctcaccacctgggatatagattaaatctggacagagaccacatactctttttgcagggtctcactctgtcacccaggctggggtgcagtggcgtgatcacagctcaccgcaacctccgcctccccagctcaagcaatcctcccacctcaacctccccagtagctgggactactgaagcaggccaccacacccgactaatttttgtatttttttctagagacggggtttcaccatgttgcccaggctggtctcgaatcctaggctcaagcaatccactggcctgggccttccaatgtactgggattacaggcgtgagccaccatgcccaccatgagaccacataactccacgtagaccacaaaacaattcagaggcctggacacaaacaaaatgaaggtgacccacctgtactgcctggagagaccacctaaaggacatgctgttaatggaggcaaagcaagtgggaaaaaatgctcaaagaatggcctcataacctgagaaccagccctgaaaagtgttctgagatcttatacacaaacagctcagaaatcacagaaaatatattcttttaccatagtggaattaaactagaaatcaataacagaaatgtatctgaaaaatccaaaaatacttgtaaattaaacaaaacacttttttttctgtttttgagacagagtttttgctctgttgcccaggctggagtgcagtggcatgatctcagctcactgcaacctccgcctcctgggttcaagcaattctcctgcctcagcgtccccagtagctgggattacaggcgcctgccaccacgtctgcctagtttttgtatttttagtagaggcaaggtttcaccatgttggccaggctggtctcaaactcttgacctcaggtgatccacctgcctcagcctcccaaagtgctaggattacaggcatgagccaccccacccagccacaaaacactttaacccatgagccaaagagaaaatccaaagggaaattaaagatctattgtgaattgaaaaaaatgagaaaatacaacaaatcaaaatctatgggatacagctagagtagtgatcagaagaaaattgatggcattaaaatgcttacatgagaaaagaaaggtctcaaatcaattatctgaatttccaatttagaaaagtctaaaaattacacctgaaggaataaaataataaagataagggcggccaggctgggcgctgtggtgcacacctgtaatcccagcactttgggaggccaatgtgggcgaatcaccagaggtcagacattggagaccagcctggccaacacggtgaaaacccgtctctactaaaaatacaaaaaactgacacctataatctcagctactcaggaggctgaggcaggagaattgctggaacctgggaggcaaaggttgcagtgaagctgagatcacgccattgcactccagtccggactcgacaacagtgagactccatctcaaaaaaaaaaaaaatacaaaaatttagccgggtttggtggcacatgcctgtagtcccagctactcgagaggctgaggcacgagaattgcttgagcctgggaggcagaggttgcagtgagctaaggttgggccactgcactccagcctgggaggcagagcaagcttcgtctcaaaaaaaaaaaaaaaaaagaaattagccaggtgtggtggcatgtgcctgtagcctagctaccagggaggctgagcagtggggatcagttgagcctgggaggtggaggttgcagtgaaccaagatcgtgtcactgcacaccagcctgggtggcagagtcagatcctgtctcaaaatcaataaaaaataaaaatataagagcagaaatcaatgaaattgaaagcaaaaacaatagagaaaatcaatggaggccgggcaccatggctcacacctgtaatcccagcactttgggacaccgaggtgggcagatcacctgaggtcaggagttcgagaccagcctggccaacatggtgaaaccctatctctactaaaaatataaaaatagctgggtgtggtggtgggtgcctgtagtcccagctactcaggaggctgaggcaggagaactgcttgaacgcaggagacggaggttgcagtgagccaacacagtgccactgcactccagcctgggcaacagagtgagactcgaaaggggaaaggggaagggaaaattaatggaaccaaatgccagttcttggaaaaaaacaataaaattcaaagtctctagcaccaaaagcagcacatttttctcataagatccaaatttaataagagtctctgcaaaaattttctgttctttctgaaatctcaactgaaagggattttactcgaaatagcctaattaaaggtctttttcttttcaaaaaaaattatttatttatttagagacaggatcgtgctctgttgcccaggctggagtgcaacagcgtgatcatggctcactgcagcgtcaacctcctgcactcaagcaattctcccacctcagcctcccaagtagctgggaataaaggtgtgcaccaccacacccggctaattttttgtaattttggagagacagggtttcactacggtaaccaggctggtctggaactcctgagctcaagtgatcccgcctcggcctcccagaatgctgggattacaggtgtgagccactgcgcctggccaaaaatttattattttatcagtttctttggcgtgagttgaggaaatcgtatgtcctttatacttaactagactgtattggtttgtatctgactttctactatttttgatattgaatgaaccattggatagtactcaaagagcttcaaaaggacttttttctcgttaacatatgtctactgttcagaaaatttatcacgaaatttatacctacattttagcagttggagagttaaataaacacaaaaaacagattctagcaaccccaagaactgaaaagattgaatttgatcatctcacagtgctctgttacacgtcgttatgcataaacaaatcctaagaactcgtgaatttaccacaaattgtactggatattcaatgcaaataaagccaattttgtgcttacttgtgagggagagctgtacttgtcagacgatatattccggaacaaagccagacctttgggaaagttttgggaagccaggtcttcagtgatgggcacacattgagaagcgggaggctggagaggcaggccatggggctttctagcatgttcctctactcacggcagtaaggctgctatcgaggtgcaactttaaaatggcggcgacaggaaggattgctcgctgattggctgttgtgtagaagggtggggctgtcactgattggctgactttggctgactttcatggggtccattgctaattggctgagtttcaggactgagcgtatcacctagtgataattgagtatacttcctgatttgcttgtcccttctcttagtgtacatggagggatggaatttctgggtcaccagggatgcatatctttaaattttcctaaataatttcaaatgcggccggatgcggtggctcacacctgtaatcccagcagtttggtaagccgaggtggaaggatcgcttgaggtcatgtgtcccaaaccagcctggccaacacggcaaaaccccgtctctactaaaatacaaaaattagccaggcagcacacgcctgtaatcccagctactcgggaggctgagaggcaggagaatcacttgaacctgggaggcggaggtcgcagtgagccgagatagcaacacggtttaggtagcagccaccccctaattccatctccacctctttctttaccttcccctgccaactgggctctctgcaaacctagaaaggtcagggagagatgggggtgagtgttactcacatgccagctcgggagttgtctctagttcccacttttttttttttttttttttttttaaaagacagtcttgctgtcgcttaggctaaagtgcagtggtgagatatcagctcactgcatccttgacttcccgggctcaagcaatcttcccaccttagcctcccaagtaagctcccacattcttcatgccctacatgagcagtggctcacagtcaagtcctgatcccttctccatagggcctgcccccattccaaccacttatacctcccctgatgtcccagggccctgcgtgttctctgagctctcacctggctgtacagcccaggtgcgactggtgaatattttctctttctttcttttttgtttttttttttttttttggacagagtctcacttgcccaggctggagtgcagtgataagatcttagctcactgcaacctctgcctcctaggttcaagcgattctcctgcctcagcctcctaagtagctgggaatacaggctttcgtcaccacgccaggctaatttttgtatttttcgtagaggtggggtttcaccatgttagccaggctggtctcacacctgtaatcccagcactttgggaggccgagaggcggatctcctgaggccaggagttcaagaccagcctggtcaacatgttgaaaccccatctctactaaaaacacgaaaattagccgggcgtggtgggatgagcctgtagtcccagctattcaggaagctgaggcaggagaattgcttgaacctgggaggcggaggttacagtgaaccgtgattgcaccactgcactccagcctgggcgacagagtgagactctgtctcaaaaaaataaaaataaaaataaaaataaataaaaactgaggccagtcacagtggctcacacctgtaatcccagtactttgggaggctgaagcaggaggatcacttgaacccaggagtttgagaccggcctgggcaacatagcaagaccctgtctccacaaaaatttttttaaattagaaatttaaaaaattaaaattgatccatattcccattagtagggatgtttaaataacacatctgttaatcttgagttaatggaaagagccaggaagggtccggtttggtcttgtatctgtaaaattaaaattaggaacagttaaacaaatgtcttctatggtttttgttacttgagcccaggggttcaagtctgtagtgagctatgatttcactgctgcactccagcctgggtgacagagaagaccttgtctgtaaaagaaggggaggagggcaaaaatatataaaattaatattagcaaatttttttttttttagacagagtcttgctctgtcgcccaggccggagggcagtggcacgatattggctcactgcaacctccacctccctggttcaagcaattcccctgcctcagcctcccaagtagctgggattacaagcgtgcaccatcatgtccggctaattttttttgtatttttaatagagacagggtttcaccatgttggccagactggtcacgaactcctgacctcatgatccgcccgccttggcctcccaaagtgctgggattacaggcatgagccaccacgcctggccattagcaacttttaaacaaatgtcttgtatgcttttcattacttataaaaggctctctgaaggataggatggggccatcttagagatctggaccaaacaccaatgtgattcttccagaagactgcaatttgatggactatgtcagagatgagaagaccgaattcctggctccctttccacatcttcctgatctcaaggcttcaggattggagtctgaaaatgtgaattctagctatgtagctttgaccaagtcatgtgtcccccgtgggactcagttttccttctgcccagtggggaatcataagcgccattctgacttgtcacagggtttcaggtttgttgggagattacaagacagtgaaaatgaagtatctttgactaattaaatcatctgtctcagaatataacacattttaatgtttttatttattattattattattttttacaagcgtgtgccaccatgcccggctaatttttttgtatttttggtaaagacagggttttgccatgttggccaggctggtctcaaactcctggcctcaagagatcctcccaaagcactggggttactggcatgagccattgcgccccgccaaaagttgtttctttggagcaaaataggtgataatgccaacgtattcgcttgctaagatttccattacagaataccacaggctgggtggcttaaacaacagagtttattttctcacagtctagaggctggaaatcaaagatcaaggtgtcagcagggttggtttcttctgaagcccgtctccttggtttgtagacagccacctcttccccgtgtctccacacggtccttcctccttgtgcacccatgtttgtgtcctgatctcctctccttataagggccacaagacagattgaattgcagcccaccctgccaacctcattttaacgtaatcacatctttaaaggccctatctccaaatacactcacattctgaagtactaggggctttaacatatgaattggagggggacaaaattcagtctataacagccagagatgaatgttatctatttgcgtgagatgaggaaagagtaggaggcagctggctgcatctgggctgtgttggtttgctttgggaagagctcatcaggtatgggcaggttgctcactcagtggtggacatgggtagcaacacatgctttgtcaatgaaaatacataatcatgacctcatcgttttggtaaaaaaataacaattttttgttgttgttgttgttgagatggagtctcactctgtcatttaggctgctggagtgaagtggtgtgatctctgctcactgcaacctctgcctcccacaagaaattctcctgcctcagcctccctagtagctgggattacaggggcccgccaccacgcttggctaattttttttttttttttttttgagacagagtcccgctctgtcacccaggctggagtgcagtggcgcgaccttggctcatcgcaacctctgcctcccgggttgaagcaattctcctgcctcagcctcctgagtagctgggattagaggtgcacgccaccatgcctggctagtttttttgtatttttttagtagagactgggttttaccgtattggtcacgctggtcttgaactcctgaccccaggtgatccacccgcctcagcctcccagagtgcttggattacaggcatgagccaccgcgcccagcctaatttttgtatttttcgtagagatggggtttcaccatgttggccaggctggtctcaaactcctgacctcaggttatccgccccaccttggtctcccgaagatctgggattacaggcatgagccactgcgcccagccacaaagatgtaaactaaaaaaaaaaacactccaaatcccactaccaacaaataaccaacgttcacaccatgctgtctccacatacacagatagaaggcaagaacactggagcaaaaaaaaaaaaaactggagcaaaaaacaaaaaaacaacactggagccaaaaataaaagaaggcaagaacactgggttgagagacagaaagaaacaaaagcaatttttacaaatgtgtgtgtactataagtgttaaagtaaaagttgttatacttttctgcaattgaatcaacagaagaaaaccaaatggttgctatgctagtttcttcattgttaatgctgctgtaacaagttaccacacacttagtgggtcaaatcaacatgaatttcctctcacacagttccttttttttttctttctagagacagggtctcactctgtcacccaggctggagtgcagtggcgcgatctcagctcactggaacctctgcctcccaggctgaagctatcctcccacctcagccacctgaatagctggggccacaggcgcgccaccaccatgcccggctaatttttacattttctgtagagacgggacttcgccatgttgcccaggctcttctcaaactcctgggctcaagtgatgctcccgccttggtctcccaaagtaccaggattacaggtgtgagccaccatgccctatcatacagttctggaggtccgaagtctgccatgggtctcagtgagctaaaagcaaggtgtcagcagggctgtgttgtcttttagaggctctaggggagaaactgttttcctgttttttccagcttccagaggtcacccacattcctttactcatgaccttcttctttcatcttcaaagccagcaactgtggttgtgtcttctcaagtcacatcacttctgcctccttctacttttaaggacttttgtgatgaccttgggtctactggataatccaggataatttctctgtcttaaaaccaactggttggaaaccttaattccatctgcaaccttagctccttttttttttttttttttttttttttgagacagggtctctctctgtcgcccaggctggagtgcagtggcgtgatctcagcttactgcaacctccacctcctgagttcaagcgattctcctgcctcagcctcccaagtagctggtaccacaggcgcgtgctaccacgcctggctaatttttgtatttttaatagagatgggattttgctatgttggccaggctggtctcaaactcctgacctcaagtgatctgcccgccttggcctcccaaagtgctaggattacaggtgtgagccaccatgcctggccttagttcctttttaccatgtaacatagaatatccccaggttccagggtgcaggcattgttctacctacacaggaggaagggagggagcgtacagggaggtggccatccacaaaagtttgggtttttcttggagggaaggcgtggaaacaccacgggccccaagactgggagagcagggttgactctgagctgcgtttgcaggtggcagtgaaacagccgacagatggaagctgaaaggctaccagaatatccactcttccccagggactccgatgcagggttaggggctctgagtggagacagtgtcaaggcctcagctgaaggcaggtcgttagctctgaaagcagcaccagctcccctgtgacaggggagctctctgtctttctctggcagcccttgactccatgccactccccctgcccctgccctacctcctgcctccaagggcctcccacattcccaggaatgcagacttcacctttctcttctgtctcccttaaacccagtcagcctcagcagtttagggctataaagtccagcagaaaccatcttgtctaaccccctcactgaacaaacggggaaatgagcccctggctctgtcccaggaatcccttatatacactcagagtgacttcttcaaggacaaccaaaaatgaccttaatcccaggggaagagaaatcctcgcccctactaggtggcagtctctacaccttccctattcaagactcagtaggggccaggtgtggtggctcacacctgtaatcccagcactttgggaggcagaagcgagcagataacctgaggtcaggagtttgagaccaggctggcgaacatggtgaaaacctgtctctactaaaaatacaaaaattagccaagtgtggtggcgcatgcctgtaatcccagctactcgggagggtgaggcaggaaaatcgcttgaacctgagaggtggaggttgcagtgagccaacctcacaccactgcactccagcctggacaataagagcgaaactctgtcttaaaaaaaaatactcagtgggcagccaggcacagtggctgatgcctgtaatcccagaactttgggaggcccaggtgagaggattgcttgagcccaaggagtcggagactgcggtgagctatgactgtggcactgcactccagcctgggtgacagagtgagaccctgtatcttaaagactcagtgggccttctctgaggtagactttacagcccagcccccagggccaagtcaaagccacagggtcaccaatgcatggagtgtcctttgagatcactaagctcacctcctcctgatacagaaaaggaaaacaagatgcagagagtgcaagggacagaaaccaagccacacagcagtgccaatggagaactaggcctagaactcagctcaccttgcttccaagtctgtggttctatgaaatatgctttccactgctttccctacaatcttcaactctatccccttcttttgcactacccgatccctattctcttcagatggagggcagagatacatccccccaacaactttttttttttttttttgagacagagtctcactctctgtcgcccaggctggggtgcagtgtcgcgatcttggctcactgcagcctccgcctcctgggttcaaacgattctcttgcttcagcctcctgagtagctgagattacaggcgcacaccaccattcctgactaattttttttttattattattagtagagatggggtttcatcatgttggccaggctggtcttgaactcctgacctcaggtgatccacctgcctcggcctcccaaggtgctgggattataggcgtgagccacctcgtctggcctctaatagggctttctgttacttaaaggggaagaatgcctaactgccaaagtctctttacacataatctcttaactacccttaggatggccaggctaggttctagcatgcccattttatggacagggaaactgagctaccgagcctatgtgatttcagtgtttgtcctcaagtcctcagaaactccagatttgagagaaaggcaggcattttctttggagtagaaatacactctctaataaaaaggcaacccacagaataggagaaaatatttgtaaatcatgtacctaacaagcgattaagatccagaatgtatagagaacccccaaaactcaacaatgaaaagacaaacaacccaattcaaaaatggataaaggacttgaatagacatttctccaaagaagacatacaaatagctaataagaacatgaaaagatgttcaacatcactaattattagggaaattcgaatcaaaactagaatgagataccacctcacatccattaggatggctactattgaaaaaaaaacaggaaataacaagtgttggcgaggatgtggagaaactgaaacccttatgtactgttattgggaacataaaatggaactgccacagtggaaaacaaaatgacagtttcttaaaaagttaaaaataggctgagcgcagtggctcacgcctgtaatcccagcactttgggaggccaaggtgggaggattgcttgagctcaggagttcaagaccagcctggccaacatggcaaaaccccgtctctaccaaaaatgtaaaaattagccaggtatggtgacgtgcacctgtggtcccagccacttgggaagctgaggcagaaggatcacttgaacctgggaggcagaggttgcagtgagctgagattataccactgccctccagcctgggtgacagagcgagaccctgtctcaaaaaaaaaaataaaataaaatgaccatatgattcagcaattccacttctgggtatgtatccaaaagaattgaaagcagggttttgaagagatatttgtacaaccatgcccatagcagcattattcacaatagctaaaccatggaagcaacccaagtgtccacagacaggcgaatggctaagcaaatgtggtttatccatacaatggaatactattcagcctcaaaaaggaaggaaattccggcttctgacacatcctacgacatggatgaacgttgaggacaactatgctaggtgaaataaaccagtcacaaaaagacaaatactgtatgattccacttatatgagaaacatagtgtagtcaaagtcacagagatgggccaggcgtagtggcttacgcctgtaatcccagcactttggaaggctgaggcaggaggatcacttgagcctaggagttcaagaccagcctatgcaacatagcgagaccctgtctctacaaaaaaagttaaaaattaagccgggtaggctgggcgtggtggctcatgcctgtaatcccagcactttggcaggccgaggcgggaggatcacgaggtcaggagatcgagaccatcctggctaacacgctgaaaccccatttctactaaaaatacaaaaaattagccgggtgtggtggcgagcgcttctagtcccagctactcaggaggctgaggcaggagaatggcgtgaacccgggaggcggagcttgcagtgaggcgagattgcgccactgcactccagcctgggtgacagagcaagactccatcccccccacacacaaaaaaaaattaggccgggcgtggtggctcatgcctgcaatcccggcactgtgggaggccgaggcgggtggatcacgaggtcaggagttcaagaccagactggccaacatagtgaaattttgtctctactaaaaatacaaaaattagcccggcatggtggcgcgtgcctgtagtcccagctactcgggaggctgaggcaggagaatcgcttgaacctgagaggcggaggttgcggtgagccaagatcatgccactgcactccagcctaggcaacagagggagactccatctcaaaaaaaaaaaaaaagaaaaaaattagccaggcatggtggcatacacctgtgggcctggctgctcaggaggctgaggtaggaggattgcttgggcccaggagttcaaggctgcagtgagctgtgattgcaccgctgcgctttgtgctgggtgacagagtgagaccgtgtctcaaaaaaaaaaaaaatcatagaaacagaaagtagaagggtggttgccagaggcttgtgagaggaaagaatggggagttgttgggtacagagtttcaattttacaagagaagaagagttctggaaatggatggtggtgatggttgcacaatactatgagtgtatttaataccactgaatggtacacttaaaatgattatagtgataaagtttgtcatatgtatttcaccacaattttttaaatggggaggaggagaaagaaatgcatctgctaaacaagcgctgtcccagcgcattggtgggcctgtgtttgcaggaacaccaactggccctgaaggtggccatggtttgggaagccctggctgctgcctctctggttctctgggctttgtcctgggagatgtgctggggccagcagtggatggggaagaagcacggtaggtctctgttactcaacagaaagtgcctccattctaaggagacaagaaatcgtctgctggaaacatttagtgaaaccaaagctatcttggatccgtttatggaaaggagtggctgagttctaccagatgtaccctgaagcctgttaccaaagccaagccaagcgtcagcaccaagcagtacctcattcacctctggatctctgaagaacagggtcccacgtccaggagcctcccacaatggagccagtgtccaggttggaggtgcagatgctctcctggttaccacctctgctctggcctggttcccttcaccctggacagagctcttcctgcagtagaggaaagagccatctcctggaagccaggaggtccttctggaagaatgcttccctgtccctgagcttcccagtgtgcagagagcttctccacacaggatttgatccactgtattgaggaattccttctcctgcagtaacaaaccaacccgacaatgccatggcttcacacgctaataaaagtttatttcttgctctcatcacagactgctgtgggtgttcctggttgatgagcggacttccatgtgggggctaaggactccagcctccttggacactgtggcctcaccaccctccactagggctcaagaactccaaaacatagacaaagagcaatggggaaagcactactgcttcttaaggacacaaaccattttagctcaagttccatttgggagaactggtcgcatggccccacccaggggcaagggacagtgggaagtggaacttctggctggacagctattttgcaacagctcaacgtgcgtgacttttgggagcagctaaacatcactgtgacaccctgtcagatgggtatcatccccgtattactgatcaggaatctgacggtcaatgcaggcaacggactcactccaggtcacttagctagattcgttatcatgatcacaaactaggtgtcccctcttccagctcctggcctgatgccaccttgatcagccagctcactgctttgaattttaggaagagtctcaggcctcctcatccagagggtgctttactttataaagcagttttaacctgagaacttcacctcatcctcaaaatgtcctggtgagggaagcaggaagccagtgatccccatttaacagattaaaaaaaaaaaaaaagcaactgagtacaatcagttctgaagagcagtgaaaagcccaaggtcccaggcactgcagaccttcccagcaatagattccagatgtttctcttcctccggtatcctcaatgtccatgaaaagaggcaggctgtgggtcttccacattgatgaaaagtgaagcccacattctagaacccatgtgtcatgtgcactgcttaggtgatattcaaactttcccccctttcgtcagtgactcctgaatgtgcacctccagcatcattccttccccaatgtgtgtgaccccaggggcaccctctcctcattctgtgtgacagcacagctgtccaccccatagtctgtctgaccccaggagtgtccacttaccagtctgtatgacatgagtgttcacactcttgtgatgacagaggtgtccccaccgcagggtgtgtgactctaggagtgtccaaacccctatctgtgtgactacagttgtgtccacatgccagtatgtgtggccccaggagtgcctacctccaaagttgtgtgacaccagcagtatacagccagtctgtgtgaccccaggaaggtctacaactcagtgtgtgtgagtgttcaaacccccatgtgagtgacccacgggagtgctgaccccccatgtgtagtaccccatgacagtctgctgcccttcctatgtgatcccaggaagcacactgcccagggtgtgttactccatttacaagaccccagcgatgttcacacctgatctgtgtgagcccaggataattcacattccagtctgtgtaacccgagggccgccccacactgcagctgctgtgacctcagcagtatctactcccaaatctgcataccgaggagtgtccatgactatcctgggtgaccacggcagcatccacaactcagtctgtgaccccaggggtgccaattcatcatttttttttggaccacaggaatatccacttccctaaaactgagattgcaggaatgttcctaacacagcctacgtgaccacaggactgtcccccccttagtcactgtggccccaggagtgtccacaccccagtctgtgtaacactaggagtacctggtccacaatgtgtgatttcaggggtgcctgccgcccagtgtgtttaatattaggagtgtcccaaaccccctgtgtgaccctggaagtgtccactctccagtatgggtggcccttggagtgttcacacctctgtctatatgaccccaagtctgtccacagtccagtctgagtgactctagcgatgtcgaaacccccatctttgtgaccggccagcactctaggtgacctcacaattgcccacacctcaggctgtatgagcccaggagtggccacattccagtccgagaggccccaagaggctctacattccaatctgtgtgaacccagggacgtgcacaccccagactatctgacctttaggatgtccacatcctcgtgtatgtgaccctaagaatgtccactagccagtctggatgactcaggagtgtctgcttcccggtctacgtgggaaatgtccacatacaaatctatgtgaccctgggaatgtccacactccaatcattgggaccccaagactgcccacccctcagtttgtttgacaacaagagtgttgacaccctagtcaatctgaccccagaagtgcctgcatccccctctgtgtgaccccgaaagtgtgcattctccagtgtgtgtgattcctggagtgtccgctctgcagtgtgtgtgagactcctggaatgtctggaaccccatctgagtaacccacagctgtccacatgccagtgtgtgctgcctcaggtggcattcacacttctatctgtgtgaccccaggagtgctcacaccccactctgtgactccaggattatccacacccctgtctttatgactgcaaggttgtctacacaacagtcgtgtgatcgatcccaggagtatacacacaacaattgcacaacagcaggttccaagacagtactaagttcctcaccaccgccactcctgcacaccctctgtggtgcgacctgtgaggggctgttcatgcctcaattcaatggatcattttgtcccaagctccctccaacaccattaagtggtctcttctattcctattgcccctctgtctctccagtggaccattcaatttccatcccccacttcccaaccacatgtacacacacaggtgcccacctgcatacacatatatgtgcatgcacatccccaaatagaccatcccagcatcagaccctgcacagcttgtagggagcaaagatcaaggaagccaaccccctgctgcaggccccaccccatagagagtagtggggaggaaatcaggaaatgcattcctgatgagagtaaaaccttctaggaccttgtgaagcatctacagaaatcaatattggacactctccccactacccccagctccatgtgggcagggacatttgtctgccttattttctgttgtctggccagcacttagaacagtgctgggcacacagtacacacacattaggtgtttgttgaatgaatgaaacttgatccagcaattccacttcttttttttttttttagttttttttagttttttttagtttttgccctgttgtccaggctggagtacaatggtgcgatctcagctcgctgcaaccaccacctcctaggttcaagcaattctcttgcctcagcctcctgagtagctgggattacaggtgcctgccaccacacccggcttatttttgtattttcagtagagacgaggtttcaccatgttggccaggctggtcttgaactcttgacctcaggtgatacgcctgcctcagcctcccaaagtgctggaatcacaggcatgagccactgcgcctgacctgagcaattccacttctaactctaacactcacacatgtgcacaaagctgtgtgcacaaggctggtgggagcagatcagaaaaaccttgtaaatgtccatttataaagaatgactgttgcagagtgaaatgaatgatggaggttcatgtcgctccacagagcacttgctggacatgatacagaatgaaggggacctgctgcatttctggagggattgcagaggacttcaaggaagcagggatggtgattcctaccacatccccattcaactctcctatttggcctatgcagaagacagatggatcttgcagaatgacagtggattagccaggtgatgacttaagcttaacgtaagcttaactaggtggtaattccaactgcagcggctgtaccagaggtggttgcattgcttgagcaaattaacacatcccttggtacctggtgtgcagttatttgatctggcaaaggccttttttctccatccctgtccataaggctaccagaagcactttgaactggcaaggccagctgtactctgtcaccatcctgcctcagtggtatatcaatcaactctccagccctatgtcacaatttagtccacaaggactttgattgcctttcccttccacaggtatcacagtggcccatgacattgatgatattatgctgagtagacatagtgagcaagaagtagcaactactctagacttattggtgagaaatttctgtgtcagagggtaggaaataaattcaacaaaaattcagggatcttctacctcagtgaaatttctaggagtccagtggtgtgaggtctgtcaacatattctttttttttttttttttttttttgagatggagtctcgctctgtcacccaggctggagtgcaatgatgcaatctcggctcactgcaaactccacctccctgttcaagcgattctcctgcctcagcctcctgagtagctgggattacaggcacacgccaccatgcccagctaatttttgtatttttagtagagatggggtttcaccacgttggtcaggttggtctcaaactcctgacctcatgatccgtccgcctcagcctcccaaagtgctgggattacaggcgtgagccactgcacccagccaatatattccttctaagatgaaggataagtagttgcatctggcccctcctacaatcaaaaaagaggcacaatgcctggcacacctatttggattttggaagcaacacattcctcatttgggtatgttacacatgcccgtttaccaaatgacctgaaaagctgcaagttttgtgtggggcccagaacaggagaaggctctgcaacatgtccaggctgctgtgcaagctactttgccacttgggccataggacccaggagatccagtggtgcttgaagtgacagtggcagatagggatactgtttggagctcttggcaggccgctataagttagtcatagcctagccctctaggattttgttttattttattttttgagacagggtcttgctctgtcacccaggctggagtgcagtggcacaacacagctcactgcagccttgacctttcaggctcaggtgatcctcccacttcagcctccctagtagctgggactgactgcaggtgtgcaccaccacatctggctaacttttgtattttttgtagagatagggtttcccaatgttcccgaggctggtctcgaactcttgggctcaggcaatccacacgtctcagccccccaaatgaaatttggtgagcctcctttaggattttggagcaaagccctgctattctctgcagataactaccctccttttgagaaacagctcttggctgggtgtggtggatcactcctttaatcccagcactttgggaggttgaggccaacacatctctctcttgagcacaggagttcgagaccaccctgggcaacatggcaaaaatccatctctacaaaaaaatacaaaaattattaatagctgggtggggtggtgcatgcctgtagtcccacctactcaggaagctgaggtgggaagatcgcttgagcccaggaggtcgaggctgtagtgagctgtaattgtgccactgcagtgcagcctgggtgacaaagtgagaccctgtctcaaaaaaaaaaaaaaaaaagagagagagagagaaacagctcttggtctgctactgggtcttagtagaaactaaatacttgaccatgggccaccaagttacatcattcctgcccatcatgaactgggtgttacctgactaaccaagagtcggtgtgcccagcagtgctccatcgtcgaatggaaatgggaaatatgtgatggggcctaagcaggccctgaagacacaagtaagttacatgaggaagaggcctaaatgcccatggtccccactccttctaccttgcctcctttctcccagcctgcaactgtggcctcatggggagttccctacaattagttgacagaggaagagaagacttgggcctggtttacagatgattctgcatgttatgcaggcacactctgaaagtggacagctgaagcactatggcccctttctgagacacctctgaaggacagtggaaaaggacagttaataaggggtggacttgtgatggtaaattttgtgtcaacttgatagggacccagggtgccctgttgaatattatttctgggtggatctgtgagggtgtttccagatgaggttagcatatgaattgttggactgagtaaggcagatggctctgcccattgtaaatgggcatcacccaatccactgaaggttggaatagaacaaaaaagacggaggaaggtggaatttgctctctgcgtgactgcttgaggtagaacaccagtcctttgcccttggctggtacttacaccatcagccctttttttgttttgttttgttttgttttttagagacagagtcttgctctgtcacccaggctgaagtgcagtggcacaatctcggctcactgcaacctccacctcccaggttcaagcgattctcctgcctcagcctcctgagtagctgagattacaggtgtgcgccaccacgcccagataatttttgtatttttagtagggatggggttttgccatgttagccaggctggtcttgaattcctgacctcaagtgatccaaccaccttggcctcccaaaacgctgggattacaggcgtgagacaccatgcccagccaacaccatcagccctttggttctcagaacaacaccactggctctcctgggtctccagcttgctgatggcatattgtggaacttctcagcttccaaaatcacaggagccaatccttgtaatatattacatattggttctgtttctcctactggttctgtttctctggagaactctaatacacccagcaattccacttctaattctagtactcagacatgtgcacagagctgtgggaacaaggctggtaggaacaaacaaccaggaaaatcttgtaaatgttcactgatacccaaggactattgcagagtgaaacgaataatgagggttcatgttacagcacagagtgcccactggacgtgacacagaatggatgggacttgtgtgtacctgcaagggtgggggttatcttctacaggatgtgctataggcagggaaaagcaagggggagtcagttacagtgacctagtgcatgtgtgtagtgtgcgcacacacacactatggaaacacagggaactgtatctggaaggaaacaccagaatctgaccccagtggtcattctgggggaatggggatagagatgattgctagagtccatgtactgatgtgttgttcaaatctttttttttttttttttttttcgagagaaagagtctccttctgtcatccaggctggagtacagtggcacgatctcagcccactgcaacctctgccaccaattcaagtgattcttgtgcctcagcctcccgagtagctgggattacagctgcgtgccaccatgcccggctaatttttgtatttttagtagagatgggggtttcaccatattggccaggctggtcttgaactcctgatctcaattgatccacccgccttagcctcccaaagtgctggaattacaggtgtgagccaccaccctcagcctgtttttcaaatcttttatacaaacctgtattcacatattatttgtgtaactctttttaaaggaaaatcatatgcttaaaaacaatatctggccgggcacggtggctcacgcctgtaatcccaacacttcaggaggccaaagcaggccaattgtaggcaacatagcaagacctcatccctactaaaaatacaaaaattagccaggcgtggtgacacacacctgtagtcccagctacccaggaggctgaggcaggaggatcccttgagcccaggagtttgaggctgcactgagccatcatggcgccagtgggctccagcatgggtgacaaagtgagacactgtctcaaaaaaaaacaaaaacaaaacaatatccacaacacaaagtgtttgtgttgggggtaactagaaacaaaaatctcaaactcacatgctccaggggccagacaagtaacctgtaagggagatgggggagttctgctcagggtaaagtgaacagcaactgggctgatgaatgttctctgactctcagcagcggaaggtgagggtgagtgaagggtgagtggggaggaggaggaagactgcaaatctcatcccccaaaactcatcccccaaaataattcaggaacatcacaccctggggctcagaacttttttttttttaaacagagtctcactctgtcacccaggctggagtgcaatggcgcgatctcggctcactgcaacctccgcctcccgggttcaaactattctcctgcctcaggctcctgaatagctgggactacaggtgcacaccaccatgcctgggtaatttttgtatttttagtagagatggagctttaccatgttggccaggctggtctcgaactcccagcctcaagtaatccgtccaccttggcctcccaaagtgctgggattacaggcgtgagccaccgtgcttgaccaaggggctcagaactcttaagagttcagggatcttggcttggaaacagacacctaatgggtcagagcagtcatactctaactcagatagctcacaacttcatacccctgacacacactctcaaacagctcacagatctcacactttggagacatacccctaagtagaccagaggcatcacacgctagaataaagatccccttaatacttggtggtttttcagtattattattattgagatggagtcttgctctgtcacccaggctgaaatgcaatggcgccatctcggctcactgcaacctccgcctcccggattcacgcgattctcctgcctcagcctcccaagtagctgggattacaggcgcccgccaccatgcctggctaatgttttgtatttttagtaaagatagggttttgccatgttgtccaggctggtctcgaaatcctgatctcaggtgatccacgtgccttgtcctcccaaagtgctgggattacaggcatgaaccaccgcacccagccttcagtgttaacaagaagtaatcccttacacacatccactttaagctttcaattttgaggccctgaatttaatgttaaagtccttccatttgcactacctacctgtgtcacctcccacagtcctcagcctgtgccctcccattcctgccccttgatctccaggcgctgagccagaggattgtcgggaggaccctgggcaaagacgcctaccctgccatgctgcgccatctgccctccaggctgccagtcaagatgtggggcaggactttggagaaacaggtgaacaagatggcccctggggatctggggcaagggtgttggcactgaaactggtctagtaacctgtttcccttctctgcgggctcccatttcctgtcctcctctctccctttctctttcagagacaagcagagggcagcagaggcccatggaaaggcccggctctaagccatggagggccctgtgctcaggtgtgcagggctgggccggggctgagggctggctcctcccccagtttagccagggacaggtggagagatacaaaggtggctcacgcagggtgcccccaaagctgtcatgattaaggccatgtggagagaggctaggaaacacagcgctgaccttgagctttaggagaggaattcagaggcccctggcaacctgaaggggaccttgaagaggaccctgtaggaagacagaacacttccctgtagaggaggccaaaggaggaaggacatggtgttccgggcactctgactatagggattttatatgctgtggtgagaaataaaatggattatatttttgtagagtgtgtaaaacggggcttggcacacagtaagccttgtgtgattactatgtctttttttttttttttttttgagaccgaggtttgctcttgtcgcccagggtggagtgcagtggtgcaatctcaggtcactgcaacctctgcctcccaggttcaagcgattctcctgcctcagcctcccgagtaggggattacaggtgcacgtcaccatgcccagctaatttttgtatttttaatagagacaggatttcaccatgtaggccaggctggtctcaaactcctgacctcatgtaatccacccaccttggcctcccaaagtgctaggattacagacgtgagccactgcacccagtcctttgtgtgatgactatgtcttgatcatcattttataaagcaggctttgtaacttcacctccaagagtctgcaggatccagaccctgccttgccctcccacttatctctcactcactcttgggttctgagctacgctggccttcctgttattgaagacagccatccctgctcgtccttgaatttgcaaggatggagctccgagtctgcaaagcaggatctggggagtgaatctaagctggcagggaagaatagaataatgggaggaataggtggagtttatttctaacagactatcaaaatgatgcagatgtggccaaagcagtgcttagaggaaatctatagttctaaatgcacagatcagaaaagtagaaaagttgaaaatcaatgacctgagcttccctatcaagaaactgggaaaagaatggcaagtggaacctaagaaagtagaaggaaggaaattataacagcagaaactggtgaaatagaaagcaaagatacaataaagccaacaatgttaaaagttgattctttgaacagattaataaaatactagcaatgtctattttctctcgagaaattaagaaaatatatggattgccaatatcaggaatataaacagggtattgtgacagattctacagatgttagaaggttaataagggctgggtgcagtggctcatgcctgtaaccccaacactctgggaggctgaggagggaggattgcttgagcccaggaattcaagaccagcctgggaaacatagtgagccctcacctctacaaaaaaaaagaaaaaagaaaacaaaaaatagttgggcatggtggcacacacctgtaatcccagctactagggaggctgaagtaggaggattgcttgagtccaggaggttgaggctgcagtgagctgtgatcatgccaccatgctccaggctgggcaacaaagcaagaccctgtctcaaaaagggaattaaaaaagaaagttaataaaatttatttcaacatatgactttattttcaatggagccaaaatgtcggtcattttctctttctgcagttcctatgtccatgtggatcttttgtatccaccgggagagcaaaactcagcaactttgctaatgcctcctccactcaggaaaatagaatggtacaggattttttttagctggagctcagtgaaatcaattgtttaaaatgggctggtttcaatggaactaaacgcagtggaatagaaaataataaaatagcaaagggtagaacagaatagaatggaatccaatggaatcgaatcgaacagaatagaaactagtcagactttgtgccaagcactgtccctagttgttgcagtagatatttatttattgaacaaatatgattgaactagttgtttgggaaagagtggggaacaaaacagacagaagtccctgctcttatgaagcttacattctagtcagggagacaggcattaccatctgcaaaggcccataaatgaaaggtacaagggtggtccttatgaggaacaggctaaaggacagtgtagattggagttcaagagcaatggatgaggctgtagagatagggtgtcattgtaactggagtctagattttaacaagatgaccacacatcatcatcatcatcaatcgttttatagcacttgatatgtattaggcattgttctatgcccttaaaaacagtacttttttaaaactctcacaataatcctacatgtataaaatcatgctcattttatagaaggggaaaccaaggcacagataaattagataaattatttaaacgtcaatctggttccagaatcttcttttttttttttttttttagatacagtcttgctctgtcacccaggagtccggttgagtgatcatagctcattgcaacctccgcctcccaggctcaagtgatcctcccaccccaggcccccaagtaaccagaactacacgtgagcgccccacaacctaattttcatatttttttgtagatacagggtctcactgtgttgcctaggctgatctcaaactcctaggttcaagggatctgtctgcctcagccttccaaagtgctgagattacaggtgccaccactagaatctattcttttaagcattatactccattgcctatagtgccagaccacaggtgctttataatcctgtagcatagatactataaatattcaaattactaaataattcaagtcaagagaaagatctgatgggaagtgtgctgagggcgggaaagtggaaggttggggagtggtcctccctctgggtgtcaaggtggatctgtaaacacgcacgcccagaaaccttcatttcttctgagatgcccccttcttgtcttgttctctgtgactgaagctgcagaatgggaaaggagggggctgggtaaaattggccaattcacaggactgggcctcctctgtgtcttgtcacttcttggaaaagagatgaattctatttagggaaaaacaggggagggcattgtcttggtctccactcccctaatcttcacttctggaagaggagaaagggaacaagaaggctgggtgcagtggctcacccctgtaatcccagcactctgggaggccgaggtaggcagatcacttgaggtcaggagtttgagtttaagaccagcctgaccaacatagtgaaaccccgtctctactaaaaatacaaaaattagctgggcgtggtgacacacacctgtagtaccagctactcagggggctgaagcaggagaatcgcttgaagctgggaggcggaggttgcagtgaggtgagattgtgccactgcactccagcctgggcaacagagtgagactctgtctcaaaaaaaaaaaaaaaaaaaaaaaaaagaaaaggaaacaaggaaacagtggaaagtggtcatggtagacatgtgggctctcatgaatccacacatgggcagtaagactctaccagtaagtattctctcaggcctttccccttgaaggggggtgaggaggaagtagtgtaattggggaggtagggggaggtgaggagaagaaaacacaggcgttgacaagtggcaatgtggtctcttctgacttttttttctttttttagtcatggagggacagcagtcagacccctcccccatgtcttatccgtagacttgaccacatcgtgatgacggtgaagagcatcaaagacaccaccatgttttattccaagatcctgggcatggaggtcatgacttttaaggtaagcacttccccaaatgccaaaattcaggtgggctaaaatttgttgataacactttaacatataacttaactctaaaaggaaaaccacaggaaatctgagagaaaatataaagagatcaatagaggagattccaaactgaatatttggacttccagagagagaatggagaaaaaagagaggaggaaattatcatagaaacaatgcaagataactttgcagtctctacatggaaaaggttaaccaagtatccagcatgttgacacttaacatggatccttctaaaattatagaacatcaaactgaaaaagtagatcctaagagctttcatagagattaaaaagtagattatctacaaaggaaaaaaaaacaaatatcagattttccaagagaccagagaccaaaagataaaaggacaccttcaagattctgaggggaaaattttccacctagaattctatgtccaaccaaactattaaccaaaggtaaatgtaggggccaggtgcggtggctcatgcctgtaatcccagcactttgggaggccgaggtgggcggatcacttcaggtcaggagtttgagaccagcctggccaacatggcaaaaccccatctctactaaaagtacaaaaattagctgtgcatggtggtgcacgcctgtaatcccagctacttgggaggctgaggcatgagaattgcttgagcctgggaggcagaggttgcagtgagctgagattgcactacagcactctagtctgagtgacagagcaagactgtatcaaaaaaaatcaaacaaaaatgtaaatgtagaataaaagcattcttagtcatacgaagtcttacaaaatttcccacttgctttgaaaattacctgaggctatgctatatcaaaatgggggagtggccgggcacagtggctcacacctgtaatcccagcactttgggaggcagaggttgcagtgagccgagatcgcatcactgcactccagcctgggtgacagagcaagattccatctcaaaaaaaaaaaaaaaaaaaaaaaaaaaaaaaaccaacattggatgactatgaatctgggaatatggaagacatggaagtcaggccacaatggatcccaagaggaagatcccagaaaggtacttagagaaccatcagtccagtttggaacaggtgtaagaaagaccccaggaaagacagatccaaggggaaaaaaaagaggtttccagagattgaactacccttgagaatttggaataacttcaaaaaaggtaaatgcagagaaagcaaaaaatgccttactaagatgtgcttcagtaagtgaatggatgtatcaactgtggcacatccagacaatgaaatattattcagtgataaaaacaaatggattatctgccaggtgcagtggctcatgcctataatcccaacactttgggaggccgaggcgggtggatcacctgaggtcaggagtttgaggccagcctggccaacatggtgaaaccccgtctctactaaaagtacaaaaattagctgtgcatggtggtgcacgcctgtaatccctgattacgtggatcacctgaggtcaggagtttgaggccagcctataatcccacacaggcatggtggcgggcgcctgtaatcccagctactcgggaggctgaggcaggagaatcacatgaacccaggaggcggaggttgcagtgagccaagattgcaccattgcactccagcctgggcgacagagcaagactccatctcaaatagataaattaattaaataaaataaatggactatcaatccatgaaaagacatggaggaaacttaaatgcatattactaagtaaaagaagtgggggaggctgtgcatatgtgggggcaaggtgtatatatccctatacctcctgttcaattttgctgtggacctaaaaccgctctaaaacaattaagtacacatgaacacccctcccacacacacatataacttaaatagaaagggcttgaggaatcgcaaacaggagaagaaaaatttttttagacagtgtctcactctgttgcctaggctggagtatactggtgcgatcacagttcaccacagcctcaacctcccagactcaggtgcttctcttgcctcaccctcctgagtagttgagactgtaggcacgtgccaccacacctggccaattttttctatttggctaaaaatgttaaatctaacatggaaccttatgcagaaatgtagtattatgcaacatcagactggatgtgtacacagcaacacggacgggtcttgaaaagaacgtgctgagtgaaaaatgaagaaacaatcaggtctacagcatgctacccattacaatacacacacataaaacagtaacacactttttacagcaatttatgaaaaccaaaggatacacatcaaacgcactataatggttgcctaaggtggagatgggaatggataatgaacagaaaaagataaataaaacaagagatagtccttgcgtgggccaatggtgataacgaggtgtatgatgcctcaacctctgtacttggacacaatggagtgaaatttcagaacattaggattaagaaaaatcctaaagctgcagtagtggaagatggatgtatcaccaaccaaagaataaaacgcagatgaacatcagacttcttaacagcaacaccacatttggggaagacaatgaagcaacatatttaaaaggctatgggaaaataagctgcaacctacaactgcacactgagccaaactatcctcaagtccaaaagtgaaataaagttggccagacgtggtggctcacgcctgtaatcccaacactttgggaggctgagatgggtggatcacttgaggtcaggagttcgagaccagcctggacaacatgctgaaaccccatctctactaaaactacaaaaattagccaagcatggtggctcgcgcctgtagtcccagctactcgggaggctgaggcaggagaattgcttgaactcaggaggcggaggttgcagtgagctgagatctcgccactgcactccagcctgggtgacagagcgagactctgtctcaaaaaaaaaaaaaaagtgaaataaagtcattttctgattgaatggatgtggtatcattcatagtgatataaaagagatagaaaaagaaaaaaagaaatggcacatgttgagaggtccaggagagggaggattcatgaagaacatggcagggctgtgagttaatctgtagttgatctacaaaaataaacttgcagccaagcgtggtggctcacgcctgcaatcccaacactttgagaggatgaggcaggaggatcgcttgagctcaggagttggagtccagcctgggcaacatactgagactactgtctctacaaaaaaaaaaaaaaaagttttataattagccaggcgtggtggtgcgcacctataatggaatcccagctactcaggaggctgagacaggaggattgtttgaggccaggaggtcaaggctgcagtgagccgtgattgcaccactgcattccagcctgggtgatagaatgagactctgtctcttaaaaaaataaataaataaacaaaataaacatgcaaatgggttagttaaaaattgttaaggagctaaaagagaaactaaaaacgataatcaaattgtattggaagagatagtaatgtgaatgagctaaattttcatttgtcatagcagggagttgctaaatcaagaaatagtggtgcagccgggcacactggctcacatctgtaatcccagcactttgggaggccgaggcggggaacacttgagccaggagttcaagaccagcctgggcaacacggggagacccggtctctacaaaaaataaaaaaaaattagccaggcgtggtggggtgtgcctgtggtccctgctactcagaggctgaggttgcaggatcacttgagtctgggaggttgaggctgcagtgagccgtgatcactgcactgaaggctgggcgacagagcaagactctgtctcaaaaaaaaaaaaaaaagacgccaggcacagtgactcacacctgtaatctcagcactttgggaggctgaggtgggcagatcaccttaggtcaggagtttgagaccagcctggccaacatagcaaaaccccatctctactaaaaatataaaaattagctgggcatggtggcgtgtgcctgtagtcccagctactccagaggctgaggcacgagaatcacctgaaccagggatgtggaggttgcggtaagccaaaatggtgccactgcactccagcctgggcaacagagcaagactctgtctcaaataataataaataaataaataaataaacaaacaaacagtggtgcatcagttagggactttggaggcatgtaggagaaaactcaactaactgtgggttaaacaagacaagagttttcttttcgtttcactgaacaaccagtccagaggtagttagtcaggtcatgggcagtggctgggaagcaagaggaagtgaatgagcaataagggccagcgcagtagggttgggaggttcccagaagccccatccacacctctgcccccatctcattgcctggtccagctaacgtggcctccggacgtgctgggaaatgtaggtttttaaagttgggtacacggttgaccccactgaaatttctgttgtgtttataagaaataaaggggaaatgtatactgggtaggcaaattgctatctctgccttgagtggtataaacactatttggagatatggaaataatttcaaggagaaataaactcgtacacttgcctctagggaatgagccttgggtggggcaaagggctgttgtgtagtagccccattctagtttttattttttttaaaccttgttgggataggtggaaaggcttcatctcacactcatcttggaggtttaattctaggctgttttctctgcccctccccaccaagtaggaagaccggaaagcactgtgttttggagaccagaaatttaacctccacgaggtgggaaaggaatttgaacccaaagccgctcacccagttcctggctccctggacatatgtctgatcacagaggtgcctttggaggaaatgatccagcacctcaaggtgagtgggacttctcttctttttgcaaaagctgctgcaaacgcagtgaaaacagaagaatgacccagagaggtaacaagttttaccacaaccagataatgtctgcacacagttatgtactattttgactgacaattctttcatgtaaataaatgtgtttaaaaaggaaactgtgcattcccattgtaaaacaaacaaacaaacaaacaaacctacatttatgcactgaaatactttttttttttttttttgagacagagtcttgctctgttacccaggctgtagtatagtggcttgatctcggctcactgcaacctccacctcctgggttcaagcgattctcctgcctcagcctcccaagttgctggtactacaggtgcgtgccaccacacctggctaatttttgtagttttagtagagacagggtttcaccacgttggccaggctggtctcaaactcctgacctcaagtgctccgcccacctcggcctcccaaagtgctggccattacaggcatgagccacgtgcccagccctaaatacatttatataaaaagaaaacgttcatccaagtacatgaaaaacccattatatcttggcataaaggaaaagtaactgtaaaaaccaacagctatgaaagcataacaatgtcattagattctagccacttccgttccctgtactccctggccctgacattacaaagggagatatggcaggtggttaaagagatactaagaacttgttagcatccaccttctatgtgtaaaaagaaggactgaaagaagattggagagggaataatttctgatttgttgttatttaatccagtgtctctgtaatacttaaaatgatgtcatctagaagaggcattggttgggcacggtcactcacgcctgtaatcccagcactttgggaggctgaggtggcaggatcatttgggccaggagttccagaccagcctgggcaacatagtgagatcccatctcttaaaaaaaataaacagagtagccaggcatggtagtgcatgcccgtaatcctagctattcaagagggtgaagtgggaggatcacttgagcccaggaggtggaggctacagtgagctatgatcacgccactgcactccagcctgggtgatacagcaagaccctgtctctaaaaaattaaaataaggctggggcacagtggctcatgcctgtaatcccagtgctttaggaggccaaggagggaggatcacttgaacccaggaatttgagaccagcctgggtaacatggcgagaccctgtgtctacataaaatacaaaaaaaaattagccagacgtggcggtgtgtgcctgtagtctcagctacttgggaggctaagaggtgggaggatcgtttgagcccaggttgaggctgtagtgagctgtgatcgcaccactccattctagtcagtgtgacagagcaaggccccatctctacaataaataaataaaaggggttttagtttcccttttgcagaacacggattgaggtcttatatatattctgtgcaaataacctagactccttctttgggaagtgtcagtgaaaaagactggtttggaagtaaaatgggtgaagcataggggttaagagtatggtcgttgacccagactgcctaggttcgaattctggttctgccatttactagataatactaggtactattatccttcccattttacagatgaggagatcgaggtacagggtagttaggtactgtgcccaaggccatctagctgataagtggctggaacggagtgatggaggggaggatggtaggagatgaggtcagaaagatacagcggtgttctaaggtcttctaggccactataaggaattaaattttacaggccaggcgcagtggttcatgcctataattccagcactttaggaggctgaggcgggcggatcacttgaggtcaggagttcgagaccagcctgggcagcacagcaagacctcgtctctatgaaaaatagctgggcatggtggcatgcgcctgtaatcccagctactcaggaggctgaggtgggagaattgcttgagcctaggaggcagcggaggttgcagtgagctgagatctcaccactgcactccagcctgggtgacggagcgagactctgtcacaaaaaaaaaaaaaaggcattaaattttggtctcacacacacattttgacgaacgacttttgtcttttcttcccacttcaggcttgtgatgtccctattgaggaggggccagtccccagaacaggggcaaaagggcctatcatgtccatctacttccgagaccccgacagaaatctgattgaggtgtccaactacatctcctcgtgatggaggctggacctcctccattctgtcccccttgatgtcgccctctcctttccttcctgcaaacccccacccaggcccagagatctccaaagactgaggacttaggcacttcacacatcctgctgaggggggacccaagacaggtttgggaccaaacctacatgtctgtatgtcatcaaagttggcctaataaatgcataacctctcaatgaatacggggtcttcgttactgtattggcgccatgcatgggtgtttatgtagggtgtgagatctctgagctgttcggtcggaggcctatgaccagggtatgacgcctctgagcaccgaatctagggtcatcacctcgggattcaaggcccctgacagatttctccttgtcagtgatgccattgtcttcatcctttcctaacttttctcactcctccagctgctgcctgctgttttctccattcctgggcctcgcagaatcccaggatctcttattcccatcagaccttccaggaccagcaccaggtgatactacctctttcaggagagccttctctagtctcactctcagggtatttagcactttctacctttggatctagtagatcaaagaattcgagaccagcctgggcaacatagtgagaccacccacctccacaaaataaataaagaaataagccaaatcatctcaattgaagcatagcttgtggcaggttaggtgggacaaggtcagatttcctgtttctgccccccctccaccattcagtcaactaaaatacatatgttaaccacctgtgtgccaggccctgttccaggcactggagagacagcattgagcaaaggagataagcatacccctgttggtggagttgccattctagtgggagagaaagaaaataaataaaactaagtaggtaaaatattaagtatgttacaggttggtaaatggtttggagaaaaagaaaacacggaaaagagggaatgcagataaaaactgttggggcaggttggacacagtggctcacgcctgtaatcccagcactttgggaggccgaggtaggtggatcactgaggtcaggagtttgagaccagcctggccaacatggcaaaaccccgtgtctactaaaaatacaaaaattagctggctgtggtggcgcatgcctgtagtcccagctacttgggaggctgaggcaccagaattgcttgaacctggaggcagaggttgcagtgagctgagattgcaccactgcactccttcctgggtgacagagcgagactctgacttgaaaaaaaaaattgctaggacagcttctgatgtctaatgaggcggtcccggaaagtgtgactgagaagtgtcttgagcacagatctgaagagatgagggatgagccacacagatggccagtggaggaagggcacaccaggcagaggcatcggccagtgcaaaggccctgatgcatgaatgtgcctgctgtgtgtgaggaacagcaaggacgccagttggggaagcaaggggtacagatgggtgcggtctggcaggccagggcgaggactttgtcttttactatgagcgacaggcagctgaaggagggttgtgggcagaggagggatgtgatctgatttaggatttaacaggctccctctggccactgcggaaaatagactgtcagggcgagggtggaaacaggcgaccagtgagggggaggcccctgcagtggtccacgcaagtgtgatggcagggacaggggaagtgatttttatttgtttgggttttttgttttttttggtagagtcggggtctcgctatgttgctcaggctggtgtcgaactcctggcctcaagagatcctcctgccaggcgcggtggctcacacctgtaatcccagcactttgggaggctgagacgggcagataacgaggtcaggaaatcaacaccatcctggctaacacggtgaaaccccatctctactaaaaatacaaaaaattagccaggcatggggcgggcgcctgtagtcccagctacttgggaggctgaggcaggagaacggtgtgaacccgggaggcggagcttgcagtgagctgagatcgtttccctgcactccagcctgggtgacagagggagactctgtctcaaaaaaaaaaaaaaaaaatcctcctgcctcaacctcccaaactgctgggactataggcgtgagccaccgcactcagccaggagatgattttttttttgaagttaaggcaacatttatttgatttccttataaccatattatctaaggcagaagtggtggttacttggcaagaatacaatttcttttaatgtcttctatagttgagttttagttcagaaatacatatttcactggtacaaatctgagagaccgtacttctagcatgggctcctattcatgatcaatgcatttttgtatcaccatggcttgaacaaactcaatcactgtttcaatggcaggacatggccagttgtggcagctgctctgaaggtcacttgttttactgtggcctggccaagtagaataagagtgggtcacagtgagctcactggtctcttcaggctgtgctctgaatgatgacagcaataccttggccacctccaatgcaagctgatccaacggcatattttccacctcgacgccttaattcatcaaccaatccagatcctcccagtgggtgacccaaagcaatggctcctccattcacattggttttacttatgtcaagatccaaactcttctcaacagccaagtactggggagcaaaagcttcattcacctctaccaaatccatgtccttaagactcagtcctgctttcttcagtgccccactgatagcaaggacaggaccaatacccatgatagagggatcacatacagatacaaagtagcccacaattcttgccagtggtgtgaaattatggttcttaacagcatcttcactagctatgataacagctccagcaccatcagctatccccgatgcattccctgcagtgacagtaccatctttcttgaatactggaggaagtttctgtaactattccagggttgtttggggcccagcatgctcatctacctgcattgtctgttttcctttctttgtcttcacttcaattggtgccatttcatcattaaagtagccagcatcattagcagctttccatctctgctgtgactgcaggccgtatttgtcacattcttctctgcttattttatgttttacagcaagattctctgcagtcattgccatggggagctggacatgctgatctgttaatcctatccataaagaatcttccagcttgatatctgatccaagcttggttccaaaacacacatttctgacacagtagggagcttggctcatgcttttggttcctccgcataaaacaacttcagcttctttaacacaaatttcctaacacctattcacagtggactgaaaaccagaaccacagagcctattaatcgtgagagctggggtctcctttgggattcccacacgcaaaccaacatgccttgccaaaaaaatatggaacgcttcacgaatttgcatgtcatccttgcgcaggggccatgctaatcttctctgtatcgttccaattttagtatatgtgctgccgaagcaagcatggagatgatttttttaaaatggttagattctggagatattttgaagatagggactggatgagttcaacaaaaaagaggatgtcagctagagaagaggcctgaggacattttgggttctaaaacaagagaagggacagacagatgagtcaggcaagtgggaagggaagtgtgtggattcctgagtgaaggagtgatggatggaggagcatgcgtgagagtctcctgaagtaaaggagcccctggtcttctggactctggtcgctaaatagtcttcagacggtagttcagccagaccctgtgactgaaccgccaaggagccccaagagtgctgcgaagagagggagtgtgaggatatgagttttagcaagtaaaaggctttcctaaaacctgtagcattttctggcagtggaaaaaaagaggaaaggggttttctgcctcattctaaaagacaatttgccatggacccagacattatatgcctgaagatggatgatttatggatgaaaggaaagagaaaatgaaggaatagaagaaggaaggaaggaacagatgggtggatgggtgagtgggtaggtagatgaatgaatgggtagatgctctgatatttcctccctcctcccccgagaaactccttcacaggtgtgcacagagagaggaatatgagtttatgaattgcagatttgctataatagggaaagaaactagaaacaatgcaaatgttcatcaacagattagtggttaaacaaaatgtggtatatccattccatggaatattactttcaataaaagggaacgaacttatgaggccagcattactctgatgagaaaactagacaaagatatcacaagaaaaactacagaccaatatctaagtatagatgcaaaaatcctcaaaaaaatacaagtaagtagaatccagcaacatataaaaggattatacaccacggccaagtgggatttatcccaagaatgcaaggtttggtcaactaatgaaaatcaatcaatataatgcatcatattaacataataaagaacaaacaccacatgatcttttcaggagatgcagaaaaaacatttgacaaaattcaacattccttcatgataaaaacactcaacaaactaggaatagaagagaacttcctcaacctgataaaggacatccacaaaaaacccacagctaagatcatacttaatggtgaaagttggaaaggaacaacacaaggatgccccttcttaccatgtcttttcaacactgtattggatgctctacctggggcattaggcaacaaaaagaaataaaacgtatccatattggaaaggaagaagtaaaactatccctatatgcagatgacatgatcttatacatagaaaatgttaaggaatccaccacgaaaccattagagccccattagtgcataaccattagagcaaggttgcaggatataagattttgtatcatatatgctagcaattaacaatccaaaagtgaaattaagaaaactattccatttacaatagcttcaaaatgaataaaatacttagtaataaaatgaatgaaagaagggtaagacttatacactgaaaaccataaaatattattgaaagaacttaaagaagacctaaataaatggaaagacatcacatgttcatggattggaagactttatagtgttaagatggcaatactccccaaattgatctacagacttgatgcaatccctatcagaatcccagcttgcttctttgcagaactgacaagctgattcacatgggagtgctaggggcccaaaatacaacaatcttgaaaaagaaaaacaaagttagaggactcacaccttccagtttaaaaacttactatacagctacagtaatcaagaccatgtgctactggcataaaaacatacatataaattaacgaaatagaattgaaagtccagaaataaattcatacattataggcaactgatttttttgagacagggacttgctctgttgcccagtcacaaacatagctcactgcagcctcaaactcctgggctaagcgatactcccacatcagcctcccaagtagctgggactacaggcatgcaccactgtgctcagctaatttttaaaaaactttttgtagagacagggtctcaatgtgttggacaggctgaactcctgggttcaagtgatcctcccacgttggcctcccaaaatgctgggattacaggtgtgagccactgtgtccagctagcaattgatttttgacaagtgtaccaagaccattcaatggggaaagaatgctcctttcaacaaatggtgctgagacagctgagtatccacatgcaaaagaataaagtgggaccccttcctcataccatatacaaaaaacaactcaaaacagatcaaagacctaaatgtaagagctaaaacgataaaacttttagaacgggggtccccaacctccaggccacaaacccatctgtggtctcttagaaactgggccacacagcaggaggtgagctgcggcttgctgccattcatgaagctgagcccgcctcctgtcaaatcagctgcagcattagattctcttaggagctcaaaccctattgtgaactgtgcatgcgagggatttaggttgtgcactccttatgagactctaatgtaacgcgcttgaatcatcctgaaaacatccccacttctgtggaaaaaaattgtcttccatgaaactggtccctggtgccaaaaagttggggaccgctgctttagaagaaaacaggcttaagtctttgtgaccttggattaggcaatggtttcttagacgtgacatctaaagcataagcagccaaagaaaaatagacacactggagttcatcaaaactataagctttctggctggacgcagtggctcacgcctgtaatctcaccactttgtgaggctgaggtgagtggattgcttgagcccaggagctcaagaccagcctaggcaacatggtgaaaccccatctctgcaaaaaatacaaaaattagccaggaacggtggcatgcaactgtagtcccagctacttgggggactgaggcaggaggatcacttgagcctggggggtcaaggcctcggtgagccacgttcacccccactgcactgcagcctgggtgacaaagtgagaacctgtctcaaaaaaaaaaaaagtgaaaagacaacctacagaagacaatatttgaaaatcacatatctaaaaagagtctagtatccagaatacataaagaactcttactactcaacaataaaaggacaaataacccaattcaaaatgggcaaaggatttaaataaacacttctccaaagaagataaatgggctgggcacggtggctcatgcctgtaatcccagcattttgggagactgaggcggatggatcacttgtggtcaggagttcgagactggcctggccaacatagtgaaaccccatctctcctaataatacaaaaattagccaggcatggtggcgggtgcctgtaatcccagctactcaggagactgaggcaggataatcacttgaacccagcaggtggaggctgcagtgagccaagatcgtgccactgcactccagcctgggtgacagagcaagactacatctcaaaaaaaaaaaaaaaaaaaaaaagaagatagatgaccaacaagtttatgaaaatatgctcaacatcagtggtcacagggaaatgcaaatcaaaaccataacaagataccacttcacacccacacccagtaggatggctagaatcaaaaagagggacaataaaaagtgttggaggccaggcatggtagcctgtaattccagcactttgcaaggccaaggcaggcagattgcttgagcccagtagtttgagactagcgtaggcaacgtggcgaaaatcccatctctacgaaaaattaacaaaaatttagctgggtgtgatggcatgcacctgtagtcctggctactcaggaggttgaggtgggaggatcacttgaacccaggaggttgaggctgcagtgagcagagatcatgtcactgtactccagcctggggaacagagtgagaccctgccaaacaaaagaaaaaagaaaaaaaagaaaaaagaaagaaagaaagaaagagagagagagagagagagaaagaaagaaagaaagaaagaaagaaagaaagaaagaaagaaagaaagaagaaagaaaagaaaagaaaagaaagaaagaaagaaagaaagaaaggagtgttggagagaatgtggttaaatttaaatttgaatccccatatggcagctgtggagaacacttgcagttcctcagaaagttaaacatagaattaccatatcaccccgcaattccattcctagttatatacccaagaaaacgaaaaacatatgtccacataaaaactttcacatgaatgttcatagcagcattatttgtgatagccaagagtccatcaatgggtgaatggataagcataatgtggcatttctttttccttttatcttttgagacagggtctcactctgttgcccaggctggagtgcagtggtgcaatcatggctcactgcagcctcaacttgctgatcctcccacctgagccccccaagtagctgggaccacaggcatgcaccaccacacccggctaatttttcttttttgtagacacgtgttcttgctacgctgcccaggctggtctcgaactcctgggctcaagcaatccacccacctcaacctcccaaagtgctgagattacaggtgtgagccaccgcatcctagctataatgtagtaggtattttcatacaaaggaatattattcagtcatgaaaatgaatgaagtactgatacatgctacaatatgaatgaaccttaaaaaacttatgtgaagtaaaagaaggcagttacaaaaggccacatattatatgactgcatttatatgaaatgtccaaaacagacaaattcatagagacaaagagatttgtgatggcccggggatgggaggagagggaaatggaatgggagggtgtatgttaatagatatagggttccttttgggggtgatgaaaatgttctggaattaggtagtggatagttacacaacctcgtgatatactaatcgctttgctatacattttaagagtgaattttatggttaagagcaaattttatggtatgtgaattatgtctcaataaacagaaaaagaaaaaaaagaatgaactattgatacacacgacaatgtggaagaatgtcacagacattatgctgagcaaaagcagcacatactgtatgatgtgcttccatttccatgaagtgcaaaaacaggccaaaaaaaccccaggtatcatatggtgtttatgggtaccaacatatggagtgatggagtaaaaatactcatgaggaagataaacaccaagctcaaggcagtagaaggagagagggaaatggaatcagtacaagagcatctgtaatatcgcatatcctttaaaaacaatctgaagtcaataaggcaaaatattaatgtttgacaaaagtagatgcttgttacagcaccctttatactttccattttttaaaacagtcaaccaacagtttgtttctgagggcaaacgcttgactccttaaccaggctttggttgacatttgccttggtgcttttgacaccacagtctgtcaggctctgtccccaccctgatgggctccacagtacagaagaggcacaaacagtacaaatgccatggggcctggaccaagcaggggctctagaaccccagaagatgccaggagggagtgagccagtcagggaaggcttccgagaagagaggacattgaagaagagtctcaaacttaggcctgacggagaagacgcgcggccaggacaccccacccccgccctcgtctcccccaaagcctgatctggccccactgattcccttatctgcccactcccagctgcctccttgctggctgaactgtcgccgcagacttctgagcctgcgccccctccacggggatgggggagggaatggggtgaggcctggcctcacagcctcggggtttccagctcttgctggaggcagggctctggggcgccctactcctcacccttggcttctcttcctgagcgctctgtgctctccagaaatgaagaaatggggtgagtccagcggccaaacccttgtcttagctcttagacatgcctcgagcctgccattccctgtgaggacagatttccctatgttgcgaccgctgcttctaataataataatgatgatgataattcccatttacagagcacaccatttatggtgtgccagcaggccctgtgctgagtggttcctacccacgtggggggctaggactttacccgttttccagatgaagaaactgaggctcagagggcgtctggcccaggaatcacacagcaaatcacacagcaaatcagagttgagacaagaacccagggccctggaggaacatcttcatttccacacacctatgtagaaccagtctggaggtgagggcaattatacacacttgcaccacaaggagctggtgagaatgcgatagaattatgggtggagagcgcttagcacagtgcctggggtcactcagcaaataatgccgctgctgttattattagtctattaatgctattattaatatcagaattaaacaagcctcggcaacatagcgagacttcatctctattgaaaaaaaattttttgctgggtgtggtggcatgcacctgaagtcccagctcctcaggaggttgaggtgggaggatcacttgagcccaggaggtggaggctgcagtgagccaagattgtcactgcactccagcctgagtgacatagtgagacactgtccccaaaaaatatttagtacgtatcattatcactattgttgttagaattagaatagttttagaattagtgttagtattaataatagtattagtgttagattaaaattagtattagcattagatgagtattactatgaaaattagtatgtcctcatagaagtagagagtagaatagtggttaccagcagatgggagggtaggaggcagggagggatggggagaggctgtcaatgggtacaaagctacagttagataggaggcataagttctggtgttctaatgcatagtacaatgactagagtcaacaataaatgtatatttcaaaatagctgaaagaggcgttctcgaatgttctcatcacaaagaaaagataaatgtttaaggtgatgaatatgctaattaccttgatttgatcactacacaatgtatacatgtaacaaaacatcatgttttaccccatatatatgtacaactattatgtgtcaatcataaatttaaagaaataaaattagttttagtgtcagtatcaatattacaatattggtattactcttagtgtcagcatattattagcattagtactataagtagtagtagggttagaaagggctatgtactctcccttgtatgcagtaggtactcaataaataaataggggtacttaatatttattgagatttcagattcaagtaagttaagatcatgtaacatgggttaaaactcatttagtctccccagtcactgcatggagtggcttattggggtatattattaccccatttttacagatgaggagctaaattccagaggggatggtaactctcccaaggtcacctgatccattagtggttagggcagtctatgaacgaggatgagctggctctagagaccatctcctgaaaccactgccacttaagtcagaggtgtctttgtattcgttctccttattactgatgagggttcagcatggggcgtggcacaccagcaggagctcaataaataggaattcatgggcttgctctctttcctcctcaaatctcccattgcatatgaggacactgaggctcagaggagtgagataagaatggtaagatccctccagggtgggccagtgggcaagctgaccccactgacctggggctccacccttggcctctgccctttgtaggtctcagtctccccatctgtagactaggtgggcaggacagctccttgtcccacgtgtgcatgtgtgtcagatgctttcatatagaaaaagtgctcaggttaggtacaagtctatgtgaggtctatgagacactgtggttgttgtcattaatatttggaggaggtggggcagggcaagagtgtggggactggggtgcggaggcctagccacattctggttgtcccctgctgagggctgagggcagagccacaggctacatcaatccacatcctcccatcctacctgcatgggcaccacatgcccagggtgtgatccagtctgcctggaccttcttctgagtctgtctctgaatatccctctgtctctgtctcccttctcagttctccacttctgtctttggcctctttccctttcaggttttatctgtcacttctgtccatctctgtctctcattctctctttgcctctctctatatgtctttaatggtctctggttctccccgggtgtctcgccctctttgtctctccttttcttttgtgccctctctctgcctctttccacgtctgtctccttctctattcatctctgtcactctctttctccccatttccatctctctccgcctatctctgtttttgtttgtctctctgcctctgtctctcccactccacccctttcctttcctaccctatcccactcctcgaggaatcatccctggctcccacctcagtttcccgcctccaaggcagcatggcgggcaagaagttgaggccactgtccctgggtgttcctacccccacaccctcaccccaagacagcctgttactgcggcgccaacagccacggtcgcctacatctgataagacttatctgctgccccagggcaggccggagctggcgtaagccccagtggggcgctaagtgagtgtgcccctgcctcccgccagcactggcctggcctgcaggcttagcctgggtcatcaaggtatcccacaggctctagttcaaatccagcagaacctctctgagcctcactcttctcacctgcaaaatgggtacagccacatcccttctctccctgcagccaggaagacgcacatacacaggagtctagcccacaccggccccgcacaaattaagggctttactctctgaaaagcccagtgaagtcatgaaaccatatctgctattttcatttatcttggtttcagcctattttgcttgtctggacactacagtccacgggagcctaggtcgagcgaggtccaagaatccccagggtgggcagggagggtggaagagggcctccagtgcccaagaggtgccccacaagcatgggacccgccccctcccctggactgccccacccactggggcaccagccactccctggggaggagggaggagggagaagggagggagggagggagggaggaagggagcctcaaaggccaaggccagccaggacaccccctgggatcacactgagcttgccacatccccaaggcggccgaaccctccgcaaccaccagcccaggtcagtctcagcccccagagagcccccaccaaggcaaccctgggcctgctgcccctacccttatgcttgctccaggctccccaacccacagctggtccccaaagtgtcagccagccctgaatccctttacagctcctccaacccacctgtctttccaactcccatttctaccccaaatctaccccctaaaccccacctctttctgccctctcatccactccgtccaagatatctatatcctctggatcccttcactttgctcgctatacccctaggtctgtctcccctaaacactaactctgtctcccaaaacatgactttatctccccaaatcctttccctgtcccatatctgatttccactcacccaaacttgtctctgtctccctgacttctcctccaaacctcacttttctgctcccaaaccccttatctgctctacaacgccttgtctttgccccactctctctgagcccccaaacctgtctctgatctgccaaaccctagctccatcctcttaccaccatctctgcctttcaaacccactctttgttcccaatgacttctctctgatctccgcaaaccatttatctctcccaactccctgcctgctcagtaaaatatctttgtcacttcaaacaccaagtcaactccccaaaatctgttctgccgcatgaaccctcatgtctgccttccccaaaccgtatctcagccctaaaacacatctcattgtctccctgaatctctccagctccaagcctttctctactccaattctatcttggcttctcaaactcccctttactagccacattctgtctgcccaaacagatctttgactcctaaactccatctctcctccagaaaaacccttgaactccccagacttttctatgaccctcagaatctgactcccacactacttctcaactttatttctgactctcaaacttcgccccgatcccccaacctcgtctgttttcacaacctattcctgagcccaaaatgtgtctctgaacttccaagctcgtctctgctccacaaccccgcccatatctgcctccccacaaactccatggctacaccccaaacctctctgacttaaccccatatctgaccttcaaattccacctctatctccccctaagccccatatctgccccctagaccttatatctgctcccttcagcccggtgagaccctcccttgagggctgggattggaacgttacctggggtgaggggctggggccgagggagagtggagggtgccagctgctgcctgctgccgccgttggggcaacacttactctagtggggcagctgataaggagctttcatatcccccagcctcgagataaactttatctctgtccggagagtgataactgggggtgaggaggctgggcccctgccatgggaggggtgggcagccctggactcaccaacgtgtgaggtgcaggggttgggggcagtggggctggagggagatcatggtgggtaaggtggagttgaggggatgagggaatagtggtgaaagagtgagcagaagacacacaatgagacagggaagagagggagaaacagggagagatgggaagagagagacagagacacagagacaaagagcaagagacaaaagagacatgaagagaaaggaaaaacagagagagagaaactcaacgagtaagagacagagacagacagatggccggagaaaaagaaggaaagacccgggagcagaaaaggagatagaaatgcagagatacacgcaggtagcactgtgaagaggcagagactaacacagaattagagacagagaggaaagagatggagaccaagatggggaagcaaaacactctcttcagagagcaacagcaggcaccctggggctgagaaggtgttggcggtgggcacacttgtggcccatctctttcctagcataactcccaagcctgggcctgccccttagcctgtctataccatgggtcatgtaagcaggagtgaggggcagtttgaagacagccttctagtctagccctgtcactccaccctacagacacagaaacagagcaggccagcacaatagggccagggccagcattccaggctccttatcctgagctgcatgtggctgggtacggtcaggggtatgggactagtaagaggcacgtggacataaggtcagagggcccaaagagagggaaacagagggaacagacaaacaagcaggaagagtgggagagatgcagagatgttcagagagataggagaggagagggagaaagcaagagtaacagaaagagagagccagagagagaaacatgggaagacagaaaagaagacagaaaatcatcaaacattacaaaagcacagaaagaggtcgggcgcagtggctcacgcctataacctcagcactgtgggaggccgaggtgggccgatcacttgaggtcaggagttcaagaccagcctggccaacatggcaaaacctcgtctttactaaaaatacaaaaattagctgggtgtggtggcatgtgcctgtaatcccagctactagggaggctgaggcacgagaatcacttgaacctgggaggctggggttgcagtgagctgagatcgcaccactgcacaccagcctgggtgacagagtgagactccgtctcaaaaaaaaaaaaaaaagaaaaagaaaaagcacagaaggagaagacaagctatatcatagaaacacagaaagctggggaagctacagagtcagacttgagagggaacagagagtcaggggaaagagccccaggggatagagaagtggagagctagatgacagacacacacaaggcaaaacaggcaaagggccatcccacaggtctcagctcagccccagcccatcaccacccccaatacagcagatggggaaactgaggcctgggaactgaaagagcctgaaagcagaactctggtgggcctctccaggggagagggtaccggtagaggtacctcccacctgccaccctcttcagaggaagtcagtggccttggggtgatttcaaaagttgggcggggaaggcagagataagcagtggggggtactgacccccccccaaccaagaagtagggaggaactaagggggccttctgtctgtagacgcaacagaggtggagggaggagggagtcaagcccggaaaccatggggtttctgagaaagttagagggcaagatacaacagatagggatgaagttggggagcagaggatggtgaaccccaaagtcctgggtgaagtgaccaagaggcaagggactctggtcctgcatgccatcccaccctcacccagactcttctagagggggagggaagaaaggacggggggacggggagaataagaggaagtggaggaggggaggagaggagatggggaaagggagaaaaggatgaacagaaaagggaggagaaggatgaagaaattggaggggaggagaaaatgagtagtaggagaaaggagtggagagtagatgtagacaggggaagagaggccggaagtggtggctcacacctgtaatcccagtactttgggaggctgaggtgggaggatcacttgaggccaggagttcaagaccagcctgggcaacagagtcataccccatttctacaaaaaaaaaacaaaaactagccaggcctggtggcacacacctgtagtcccagctactcaggaggctgaggcaggaggatcactgccgggaggcagtggttgcagtgagccgagatcgtgccactgcactccagcctggcaacagaggagaccctgcctcaaaaaaaagtgtgtgtggatgggggagagggagataaggtgtgtgagaaaggtagaaaaggagaatgaagacaaaaagagaaggaggacaaggaagaggggaaacaggaaaggagaaggaggaggtcaaggaggaaaagaagaaggtggaggagaaaaaggaagcaggagagaatgagaaaagagtggaaagagaaggaaatggggaagaggggggcaaagaagagatgggaagaagagagacgggagaaagacaggaggaaaagggaaggggggaagaagagagagaatggaaggaagaagggagaggtagaagcagatgagagtggaggaagagcgagaggagggaggagaggaaagacaaacggcaagagggggagaacgaggaggaagatgaaaggaggggcacacaggagtggaacggggagatgcaggagggaaaagagaggagagggaggaagagaaggaggggaaggagaggggagactaaggtgaggaggaggggggaatggggaggtgggaaggagaaatatggagactgaggtgatggagtgggaggagggggaaaggaggaagaggagcaggtgaaaggatgtggggtggaaggatttctgtgtctgaggaccccttctgtcctcgcaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccaggtaactccattgagtggctgtcttggcattggctgagtgctgttggggttgccatggagatccttggctaggtcagaataccactgtgaggatatctcagaaatggctggaagcttctcaaatggatgtgccgaccactttccctagttaagtgcagacctgggaattccaatgctcctcaacctgccatattggggcggccacactgagaggcaatactggaagtatgtggtggttgccctagttgtcgagtgatccgtggagctccaaatcccaacagtcatcctcaaaaacccacttggaaatggtcagaggttattgcagaggccacactgaccagtgggggtcaggatccaggaagcatccaatggccagcagctgttctggtagcctgtggaaaagctgggaacttggccaccatgttgggggtgctgggaaccactgcaccctgacgtgcgctgaccctagactgattttgcctcttctttcctccatccctacctgcccccaacagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtggtgagaaattcaaaaaaggacagggaagttgaggtgggaggggtggcccaaagtaaagctgagctgagcctagctccctcttctcctctccaccccaccagaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctggtaagaccacagacctgcttcaccttatacacaggaacccctgtcctcaccctgtacaagaagccacatcttcccattatataggaacgctgttctcatgattacaggaagctactgcaggccaccctgtatgggaacccctgtcccaatatcacatggaaacccttgccttcatcctacacaggaaaatctcctcatcccatatggaaatccttgccctcaccctgcatgagaactcctgccctttccttgtacaggaacccagatctatagaagctcctatcctcaacctacccttataagcttcaaacagaaacctttgtcctcaccctgcacaccagtgttttcgtccttggcttcacactggaatcaccccaggtcccttctcccagatgtgctgatggaattggactgggatgctgcttgggcatcaggatattttagctccccaagtgattccgatacgcagccaaagctgagaaccaccaatgtagtcccccatagaatacagaacaaaagaaacttataccagataggaacccctgtactggccccatacagaatcctcaggcatcaccctgtaaacaaagccctgccttcaacctgaccctcacttcttgggtcctcctgacatcccctgtgagccccttacccccacttccacatccccagggcactgatctcacatcctgtcgtcccctagattgtcagtaaacgggcaggtactcagtgcaccaactgccagacgaccaccacgacactgtggcggagaaatgccagtggggatcccgtgtgcaatgcctgcggcctctactacaagctacaccaggtgacgccctgccccttggagccacccctctgctttccctgtcttcatgccacactgccccccactctgttcctgttctacctctctcttcccccacaaccctctttcctctttcccctttccctccttcctcccccttcccccatctcttctactttcccccttcctccatctcttctactttcccccttctctgttattaccctccctccttccttctccattccctcctcctccgccctcctccttcctctcctctcccccacctccaggcatcagctaatgtccaaccccctgccctagaccttgggcagctcctatcagccttggaggctttcctaagctcagggcctcacagcctcaggattccttggacaatctcagcacccaaaaattatcttaccctgaaagaagtggggtagagagggtgtccctggttgacacagagaggcaaaggtctggagttggggacacccgcagcctcctttttggcaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaattgtgggtgtgtctatgtgtggctgaacagcagagctgagtggagtgtgtaacaatgcctgtggctctctgatgacagtgcatggctgcaatgtgtgaccatgtgaggctggctgaggcggcacatgtgacactttgtgaccaagggttatgttgtgtgattggaacaatctatgtgaaacttcttgtgaagtgtccaggtggttccatatgtcatggtaagaggccacgcagggcttgctgacggtgggggtggtgccgggtgactataagcacactggaagtgtgtgtgctggagcaggtgataaggaggtgtgcggggctgtggtcttgtggctgggcatgacgctgggggacctttgagacggcatgacgctgggggaccttttagacagcatgacagcatacgtggtgggcacagaatctggtaaagattcttggaatgttgaacaagaagtgtgtgtcaggatgtgtttgtgggtctggcgatggcaatatttcagtgcaagtccctgtgcatgggcatgggtgtgcgtgtgtgtgcattacgtgtggcatgtgccatgtcacagtgtctctgagtggctgacaacatgagcagctctgtgtacatttgtttgtggaggtctcaacagcagagtttcagagggtataagttagggactctcttccaagggacaaaagacacattcaggaaaggaacacggagaagggtggagctggaatggtagctggcaaggtcagaggccagtgctggggcgcagggttgtccgtgggtcttcctgtcggactggtcttatcttgctcagcccagctcagcctgcagccctgtgggaaatggtagagaatgagagggggagattagggggacaaagcagcccctggaggtggtttcaacctcagtaggtggggcgctccacacagtgccaaccccttccccaacattcccactcacctgggtgaactgctccccccacagcggagtctgttcctcaatttcacaaacacacaggagcataatctgagtcatgccttaagcatcctaaggcagactgcttaagtggctcaatggaggccacacagccagtggcaaggggcccagcggggcagtctggcctggtgtccatgtgctcagccacaccccacagccagcagcaccctttcctaagggctcactgtgggtcaggcggcaggctgggaggctccagttgctttagttcattagtgcctgaaataaatattctgaggaaaatatacccatactcatttcactaatggaagagtgaggcccagaactgatgagtaacttaccctgaccaccaagtttaaggagtggattttggatggggtgacacacccagcccagcaaataagtgctgctcacacttaaccgctctttatggcttcttccctagagccccggatatgggggttgcagggacccacaggtcctgaccatattataggtaagcagctgtcctccacagaacaccagcccatcagctagcgggcattccagctccactaagtagcctgctgcagaatcacaggagtctattatgctcactgtgggcattgtccacaacagccctgatcccataaaagacacgtgtctggcctcccctcagaagcccagccctcacaccctgcaggaggccccatcctctaaaaacccccttcagaacctgtgctggacacatgcctggccccaccttgttcaggagccccgggcctcacccccataagtatagctcccccagcctggtacagaagactagctctgaagctctaggggagcccttcatctaattatcgacaggaaacccatcctgatcctgtacaggaatgccagcgcttaccctgaataggaggaacctctgcctaaccccagctagggacatctggactaagctgtaaggaagcccctgcacaccctggacaggaacccttgtcctgaccatccacacaagcctcagtctccctatacgaatcctgtcttgacctcagacaggaacacctttgtactcacactgctgcagtcctgtcctccaggtagcattttaaaaacacctcactcacaataatctgagtagtaaaccatggacccagctctgtctttacagaaatccctgtcctcaacctcttcaaggaccctgactgtgtgtggaacctcttgccttcattgttgacaatgatccctgatgttgccctgcacaacaatccatgacctcacaccctatcccatagagtccacaggaacccatgatccaactctcaacatgaacctcagtctttaacttgtatagaaaaccacttcctgaccttatggcaggaatgcctgtcttgaccatttactttaagccctgacctcagcctatacaggcacctatggcctcacctgatacaggacccccccttctcactatataggtcgcatttattgatgctgcacgaggctcctgggccttaccttgtattagctccactaccctgaccctctacagcaggggttcccaacccccaggacacggactggtactggtccatggcctattaggaattggtccacacagcaggaggtgggcagcaggcaagcaagcattaccacctaagctccgcctcctgtcagatcagcagtggcattagattctcataggagcacgaaccttattgtgaactgtgcatgcaaggaatctaggttgcgtgctccttatgagaatctaactactccctgatgagctgaggtggaacagtttcatccccaaaccatcccccaccatccgtggaaagactgtcttccacgaaaccggtccctggtgccaaaaaggttggggaccgctgctctacaggaagcctgaccctaaaactgttccaggacttctgactggtctctgcagaaagcctttgtcctgaacctcaacagaaatcctttacttttacagtaatttatttacaggaatctctgtaatttacaggaatctctgatctttataggaactcctagctttactctctggaaatacactgcttaccctgaacaggaagcttaatgtgattctctataacagccttttccctggccttgtcccagaagccccacctgcaccctgtacaggaaccactgccctgacccaacaaagaaacaccgacctgaatctctgaaggggcagtgtcctaactacacagaggatctttgtcctgaacccgcacaggaacctctattacccccagcaggaacctgtgccctgagctagcacagaaaatcctgcccttacactcaacaggaacctttgatttgcctctttagagtaatccaaagaatgaaccagtataaaaaacctctacactgtacaagaacctctgttctgtacttgttaaacaacccataatcagaatcaccatgaatacctgcctggagactgtacaggaacccctgacctaacccccaatggaatcacctgatctgtctgtctctagtaacacagctctgatcctggacagaaatacctggcctgagtacgctgtgatcctctggcctggccgtctacagaaaaccactctcctggcctcaaaaggaacacctaaccttaatctgtatgggaaaaaatgccttcacagttttccctctcactttacaatgtctccaacctttgtatttccctgcaaacctgccttaccaggtaacagaatcattctcctgaccccagacaggaaacactaacctgacccagagatgctcctacccctacacagtaagagtccctgtctcaatgctttaaagagaaatttctatagcagtgctgtccaatagaaatatgtgagtcacacgggtaattttatattttcaatgtagccacattaaaaagagaaaaaaaagataaaattattttcaataacatcaatatacttaactttacccaatatattcaaatattattttaacatgtaatcaatataaaaattactgagctattttaaactttttatactgagttttgtgatctggtgtacatttcacatttatagcacatcatctcaagttagactggccacatttcaagagcagtagccacacgtggctggtagctaccatataggacagcataggtctgtggagtctacggaaccctatagcagacactgctataagctcattgagacctgttcctgttcttcctgagctcactctacctattccagcctcctctgcagatagatgtgggcacatgacagagttctgaccaatggagtatgggcaaaagtgacatataccagttccaggcctgacccataaaaatctctcatgcaatcctccatttcctctctttccctgtctaccaactgaaaaccaactaactccaaggacctagaggaggacagagtcacaaaatagagtttgcctgggtccatgaatgaacagtagtaaatattcagattggcttttgaatgagcaagaaataaacatttattcgttaagcccctgaaattctgggttacagcagctaggataatttagcctaattaataataatctctccccctctctctctctccttttttttttttttttttttttttgagatggagtcgcccaggctggagtgcagtggtgcaatcttggttcactgcaacctccgcctcccagattctcctgcctcagcctcctgagtagctgggattacaggtgtattagcccggctaatttttgtagttttggtaaagatgggatttcaccatgttggccaagctggtctcaaattcctgacctcaaattatctgcccacctaggcctcccaaagtgctgagattacaggcgtgagccaccacgcctggccagtaattttttttttttttttttgagacaggatctcactctattacccaggatggagtacagtggcacaatctcggctcactgcaacctctgcctcccctcccaggctcaagcgatcctcacacctcagcctcccgagtagctgggactacagatgcacaccaccacacccagctaatttttgtgttttttattgagatggggttttgtaatgttgcccagctggtctcaaactcctgagctcaagcaatctgccctcctctgcctcccaaagtgctgggattacaagtgtgagccattctgcctggccaataataatctcttgaccgaaatctagacacctgatctcactgtctatatgaacacaagctctgaacctatacagaaacacctgtgacccagtactggcccacctgatctctttgtaggaagctgtcataacataggtctaagaagccccatcctggccacgaatggtggctcacacctgtaatcccagcactttgggaagctgaagcaggcagattgcttgagtccaggagtttgagaccagcttgggcaacatggcgagaccccatctctataaagaaaaaaaaattaggcaggcatggtggcatgcacttgtagtcccagctacttgggaggctgaggtaggaagacagcttgagcccaagaggttgaagcagcagtgagccgtgttcacaccactgcactccagcctaggcaacagagtgagaccctgtcccctgtatcaaaaaacaaaaacaaaaaaacaaaaaaacaaaaccttaatccttaacttgcacaggaacaggaacccatagtctggagctctctagaaacccctgcttgattcagtaaaggtacaatatagaaaccataggaatccctgtcctcattctgtccaggaacatttggaatgacccaccagaggtacactagaagtgacctgaccctgcccatgaatccctgtcctcacacacctcacacaaaaggaatacctctccttaggaaaaaaggcccctaccctcaatcctgcaaaagaataccagccagatagagaccaaggcctgacactacagcacagatcggcaaactatggcattcaagccaaagccagactgtgggctgttttacatttttaaagggttgttttttaaaaagagaaaaaaagaaaaatgccactgagaccgtatgtggcctgcaaagcctaagatgtttactctctgtccctttataaagtttgctgacccctgctcttcagaaacctctcttctgatccaacagaaaaatgggccttgaccctttgcaagactccctactctatcaggctgcaggtatcagaactctagaatttttttgtagtgtgttatcattgtatgtgttttctttggtgagtgtaggggtttaaaggtcttaggtctgcaactcttttgcgctgagacaaaagataggttcacgtaggaggggtgagagggaagaggcggcaggacatcttcaagaggatcagagggcaaagctactgggcggtgagaccgtcaatctgtcagtctgatgcagaacccccggactgcttatctctccggtcccagcttatagcccggtaggaaatggtggagaatgagacagggagattaggaggacaaaccggcctcctgcagagctgacatttagacatggagtgggagttgcgggggagagggggtgcctagggacagctccccagacgcacacacactttctattactgcttgggagcagtggttacccgttggagggggcagatagggagagctgctgcccatgagaactcccatcctcaaggccattctggccctgggcactattattatcacaactttccagatgaggaaacggagcacagaactgttcagcaacttgcccaaagtcacatggttaagtcccgtaacctcagtttccttatctgcaaagcagccttaataatgggaactacctcatagaattgtggtttacaacgatgcctgtcacataatacttgctatcattaccattccctgcccccactaagactccttccactcagaatattgcggcagaatattaatagctaatattcggccagtgtttcctgtgtaccaccatagtgaatattaactcggaaaatcctcacatttagcatcgtcaccacgcctattttggccgccaccaccaacgtccagtggcaacctcgctctcggcccagccacaaccagcccgcccgcgctacgtcatcacggcgcgtcgcgcgggaagtcgcggggaaaaggtaagatgccccttcctaattccctcgcttccttgcttgctctccagacaccgccgacccgaagggctcctaagtgactggacagggacggaggggcggcggctatggcatccgggacgacagcgacgatagccgaggcaagaaaaagcttgcaccgcagccctgtcgggaaccgccggcgcctgccttttacgtaggcgcagcacagctggcgtagcacgccgacgcaccgccccgtcgcctgtgagctcgcggtgtggctcagcccagctggcgtagcacgccgacgcaccgccccgccgcttgtgagctcgcgagaggtgtggctcgcgcgaggggcgcggccttgaggcacggtcccctctggaggcgggatctgggcgggcagtcgagagacgaggcccaatggaaaagaaaagcctgagcgctcgcgtccccacaggtcgccagaaacttggtggagcgagccaagggcggagtttgagaaaggggctgcgtccaatgagtggagcggtgagtacagcgcgtcgacggcggaggcgggaagggggcggaggccgaccgaaggcggctagggactggctgaagagggttagcgaaacgttagcggtcgggtctgggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcaggttcgtgaaggaatggggtctgggctgggcttagagggtctgggaatggggcttaggagagtagaaggggcggtgattggttggaaagggcaggccctaagacggactgtgtgagcccgggggctcattgctccgtgaaagggcaagaccagggaaagagaatcgtgtaaaaggggtggagtctagcgggccgggcggggccgggtagaatggccacctgagtggagggagaaggcctgagagaggcggagtttggaaggctgtggagaatcagatcgcgtaaggaatggaatctaatagagggggcggagcctggaaaagggcagagaggtggggtcctcagggcacactagccccctcacatacccacgctcctccccccacccccagaaccgcggcaggggccaagcctcctcaactatgacctcaaccggccaggattccaccacaaccaggcagcgaagaagtaggcagaacccccagtcgccccctcaggactccagtgtcacttcggtgaggccctagacccgccctgatgagggggagagggagcaagttggtcatgccctggactctgacccttctctctgattcacagaagcgaaatattaaaaagggagccgttccccgctctatccccaatctagcggaggtaaagaagaaaggcaaaatgaagaagctcggccaagcaatggaagaagacctaatcgtgggactgcaagggatggtgagcagggcctggctgcagtttagcctcgtatgacaatcaaaacccaaaggttccccaccctggacagttccctctgactcagggcctaaaatggatctgtgtctccttttttttttcctctgcaggatctgaaccttgaggctgaagcactggctggcactggcttggtgttggatgagcagttaaatgaattccattgcctctgggatgacaggtgaggctgggtcctccaggctgtctccaaaccacaaaaatacacacacttagagcccattagcaagaataaatcttttcttaccccagcctggatactggaagcagatgatttggggaggtagggctcacacttgaaagggttcttttatgtagctaacaaacatttattgagtgcctattgtgtgccaagagttggtgatacaaatgtaccaaacaacagacaggggtccttctctaggagcggattgatgagtaggagggcagatcattaaacagccaacagcagtatgaggtgtttaatgaagacagacttaagaccaggggattcaagggtgtataatagaggatcctaaactagtatccgggcttcccagaagcctttatagaggaagagacgtttgtactgaaacagaaggatgaaacctcccgtttgctttacttttcaaaaagaatcagcaaatccttttggctatatgttcaaaatatattcaccatctgacctctcctcaccacctccactgccaccatcatcatcactcacctagacttgcagaggcctcctccctggtcccctacttccaacctcacctctattatctgttcatgcagcaacctaaaaaaatatgtatgagttgatgtctttgttaaaatactttaaggaggccaggcatggtggctcacgcctataatcccagcactttgggggggccaaggcaggtggatcacttgaggtcaggagttcgagaccggtctgaccaacgcgatgaaacactgtctctactaaaaatacaaaaattagttgggcgtggtggcacacacctgtaatcctagctacttgggaggctgaggcaggagaatcgcttgatctgggaggcggaggttgcagtgagccgagattgtgccattgcaccccagcctgggcaacaagagcaaaactctgtctcaaaaagtaaaaataaaaaaaaaaaaagtactttaagggcaaactgttgccctcaaggtaaagtccaaatttttcatcctggcctcaaaggttccacatgatctggctccacatcactttgtgacctcatcagccaatccttctcgcccacactactccccttgttcttccaacatgccaggcaccctcttgcctctggtctgtaccctgaccaacccctttcccagagattcttttcggtcttctactcttccagctgcctttcacatcccaatgagactttctcagagaaggttttgcctggccaaaccctaccccaatacctgatcttattttcctagcccatgacattgtttgctaattatcatacttgtgtgtttaccaattaatatctatatcccttatcccaacctaagactaacttactatgggaaaaagacttcttttatggaatacctatttaccatctattgaggagctagggatacagcagtaaacaaaacaaacaaaagcctgtgtcttcagggtaaagggggaagacagacaataaataaacaaaaagtaaatgatgcactgtggtagaaagagcagtgttatgaagaagcagtaaagggaggatagtaggagaaagtacagtggaggagacttcaattttaaataggctggtcagggaaggcctcactatttgagcagggatctgaagaggtgaaggagtaagtcatggagacagttggaggaagagtattctaggcgggggtgggggggccagctagagtaaagttctagggctggctgaagagtatttggttcaactgagaaccagggaagagaccagtgtaggtgaagcgaagcaaaggaaagagggaggggtaggagatggggtcagagaggtgatggaggacagattgtttagggccttctgggcatgggtaatactttggcttttactcagaatgggatgggagcctcgaagggacatgaactgattagggttttaaccagtgtctagctgctatgcacagaaaggaccgttgaggtggcgagggtcgaagcagggaggccgaggagatgccgccacagcccaggcgggagggtatggtaatagcagtggcagtggtgaggagagggtcacacaccagagctgatgggaggcaggactgacaccacagttttggggtaagcagctgtggaagggtggatggggagatgtggagagaacagatgtggagctccccagtgtcctcatgcatctgtgactgtgactccatctccccagcttcccggaaggccctgagcggctccatgccatcaaggagcaactgatccaggagggcctcctagatcgctgcgtgtcctttcaggtaaggcccccaagccaacactctgggtgaagggcagggagctgacctgacctgggtgcagcccatgccttaaccctttaccccactttattcctcatctctccccaggcccggtttgctgaaaaggaagagctgatgttggttcacaggtgaaggcttgggagccttgtagggatggggaggagcctgccctggacaaaccagggcaagctaaacgctttgggaagcaatgtcatggtctctgcagccagccttgggcaagtcgctgagcctttctgaatctgtgtcatcgcctgtaacaaggggaccagtaaacataagttcctcaggagagtttgatgtgtgtcaggtgcttagaacagggcctgatatataatcagcccatgatgagctattactgttatcatgatctgattgtgtgaatagatggtggatgtgtggacagagtgatcggggttcccccaggggcttccagatttagaggcctagtgctatgtggcttgaggaaagctagcttccagagcaggtatctgagctgaactttaagaggagaaaaagagtgagtcagatgaagagggtgactgagggaagggaagaacagacagctgaaccagtgtggccaaaggcctgaaagtaggatttggtgtggctactgcaggggagcagagaacattacctgaactgaggcgggctagggaagaaacagaatgtgtcttatatcctggctattccttcaggttgacagttgggggagccaagccctaatttgaccagggggttggtgtatggacagctcagttggggaagagacagggccctgaatctcatctcccatctgtgtctagcctagaatatattgatctgatggaaacaacccagtacatgaatgagggagaactccgtgtcctagcagacacctacgactcagtttatctgcatccggtatggatgagaactctgcgggcagggaatggtggcaatcttggggtccccatccctatgcccaccccaccctgggggaagcagctgagtggatagggctgttctctcccttactccctttctggctccccactgtctctccagaactcatactcctgtgcctgcctggcctcaggctctgtcctcaggctggtggatgcggtcctgggggctgagatccggaatggcatggccatcattaggtaggactctacagcatttgactttttacattgttttaaagtccttccttcaagtgtaaaatgtattgatatgggtaatatattcatgtgattcaagaatccaaaggtaaaaaagagaatataattaaaaatctgtctcccatccttgtcacccagacacctgcctcctctcatgggaggtagtcattggaaccactgactcatgtgtcctcccacaaagtcttattcaagaaataaataccatatttcattgattctaaggtgtacattttttcatatttgtaacatcttgaaatccagatgcatcttacaaacagtgacatctcagaattccattggcagtattttctgcttcgtttttggcatgtaaaatcatggtacatcttatcatcattggcatcccagaactgatgaaatgcaaaagctttctcctccctcccctgtttttaaccacaaatggtagtaacatgacatactcccttcgtaccatcttttcacttacacatcttggaaacctttctctaacagtatgtatcttggagcccggtagaacaccattgtgtaaatgcactctatgttaatcagtccccgactaatgggcattttggttctccccagtcatttgctgttttaaaaaaatgctacagcaaatatgctagtacctttataaaaataaaattttattttacactaacataaaataaaaatgttacttcaccctttttaaaacacaggttgtgggctaagttcctgcagcagaatgactgggtatgagaatgaatgcgttgatcattttatttttatttttatttatttatttattttgagacggagtctcgctctgtcaccaggctggagtgcagtgatgcaatcttggctcactgcaacctctgcctcccaggttcaagtgattctcctgcctcagcctcccaagtagctgggactacagtcgcccgccaccacacccagctaattttttgtatttttagtagagacggggtttcaccgtgttggccaggatggtcttgatctcttgacctcgtggtccacccacctcggcctcccaaagtgctgggattacaggcctgagccaccgcacccggcctttatcattttagtgaacattttcaaatctcctttggagacagaggggtagattggcagggggtgagagtttgagggcctccattactcagttcccggcagatttttaggcatcagcattaaaggaattggtggtccaggattagagagcaggggacagtctgtctctgcagaggaggacccctcacatactccaagctgttatttccttgtcttgcccaggcctcctggacatcacgcccagcacagtcttatggatggctattgcatgttcaaccacgtggctgtggcagcccgctatgctcaacagaaacaccgcatccggaggtcagcaacagagggcagatgtgatgggggtggcatggggtggggtgtcctggtctgggctcttcccccagattcaccttgatctccttgcacagagtcccctctctctgctgctcctagggtccttatcgtagattgggatgtgcaccacggtcaaggaacacagttcaccttcgaccaggaccccaggtataccccgactcccacctaggtgctagactcccagccacctcccacccttacaggcccagccagaaggggtccagaaggaggaaaaggcattcacattcatggggcctatcctgggatcaggatctgtgctacttttgtgtgtctgccatctctcctaatttcactctgaggcagggactgttgggttccctattttacagatagggggactgaggcttatacgttaagaggtcacacagagaagaactgggagagacgggatttgacccacaaatatttgaagatcttattcactgattaaccgttgggttagagtgaacctcaaattactgctttattttttctgattaggataatgcttcaaagtgtttgtttatcctttcagtagatagtaaaaaacaaatataaataaataaataacaaactatttgtttaaagaaattaaataatacagaagtgtctgaagcagtgagtctcctctaatttccattacctcaaaaataagtgttgacagtttaggttatatccttacagattttctctatagatgtctgaatttttattattattgttataattattaataacacactgcctaatggaataattctccacatgttcttcgacaacttgctttattcatttaacagcatatctgggacatttctccatgttagtacctcttaaagtatctcgttctttgtagtattcaattttatgactgtacctctggttatttaaccccaggacttttaagatgcctgccagtttttgctattacaggcacttctactgtgaatagtctagtaaatatgtaattctgcacttctctgagtctatctgtaggatgaatttctaacagtgggttgcttgggccagagagtcagcatactttaaagtctggtatacactgccagacttccctccaggaggggaccagcttacccttcctgcagaaagtgattgagcaagtccttgtcagtaggagacattactaagtacatgtcgagtatcccttatatgaagtgcttggaaccagaagtatttcacatttcagattttttcagattttgaaatatttatattatacttagtggttgagcatccttaatctgaaaacccaaaatccgaaataccccaatgagcatttcctttgagcatcatgttggccttcaaaaagtttaggattttagggccgggtgaagtagctcactcctgtaatcccagtactttgggaggccgaggcggatcacctgaggtcaggagttcaagatcagcttggccaacatggtgaaaccccgtctctacaaaaatacagaaaaattagccaggcgtggtggcacacacctgtatttccagctactcaggaggctgaggcaggagaatcacttgaacccaggaggcagaggttgcagtgagctgagatcgcaccactgcactccagcctgggtgatagactgagaccccatctaaaaaaaaaaaaaaagtttaggattttacagcatttcagatttcagatttctagattagggatgctcaacctgtagtagttttatctagccttcttcctagctgactacagagaatccacttatccaagatctgaagaatccaatttaggttggttgttctctagacattgctttattattttgcagcattcagtgttcctgacaggtgtctgcttttcattcctttccaagtaatctactttcctctctgcaaggttatcttggtgttcttttttttttttttttaaattattagacagggtatcactgtgtcacccaggctggagtatagtagcatgatcatagcccactgtaacctcaaactcctgggctcaagcaatcctcctgcctcagcctcccaagtagctaggactgcaggcatgtgccaccacacccagctaattttttaaattatttgtagagacagggtctcactatattgcccagactggtctcgaactcctgacctcaagtgtcctcccactgcagcctctcaaagcactgagattacaggcatgagccactgtacctagccttgatgttctaaacttttaccctggccttttcactctgtttaatagtaggtagacattttacatctgaagattcatgcttttcttaaactcttggaaattattttctattagatctttgataatttcttctttgttttctctgttctctttctaggacttctgttagtcagatgttagacttcctgggttgatcctctatgtctctctcttttttattatttatttatttatttatttatttattttttttgagacaaggtcttgctctgttgcccagactggagtacagtggcacaaatacgactcactgcagcctcgacctcccgggctcaagcaatcctcatgcctcagcctcctgagtagctgggaccacaggtgcacaccagcatacccagctaattttttaatcttttgtagagatggggtctcaccatgttgcccaggcttcttattttttatcttatgttttctgtctcttttttcttttgctgtgacctgggagattttgtcaactttatcttcaagcccttctgttgaattatgtatttagatatcctgttaaactccaaaagctctttcttcctctctgtttctatgtcctctcatacctgatcttgtttttatagagtatggattagaagtgccggctgggtgcggtggctcatgcctgtaatcccagcactttgggaggccgaggtgagtggatcacttgaggccaggagttcgagaccagtctggccaacatggtgaaaccccatctctactaaaaatacaaaaattacccagacgtgatggtgcgcacctgtaatcccagctactcaggaggctgaggcaggagaatcgcttgaacccaggaggcggaggttgcagtgagacaagatcatgccactgcactccagcctgggcgatagagggagaccctgtctcaaaaaaggaagtgccttaagtttcttctgttgtctgagttatgtctctttattctgaggctggttgaattatttttttcttggtccttctcttttatgctgatggttttcctcaaatgtctagcaatccttatttggctatttatacccaagaatgaaggcccattgtagggggctgtcagaggactactctgctgcagtgtttgtaggtctgttttcctgaaaggcatttccccagaatggggacagggaatgtccactgacaggttgcaactttagcgagtgtgggcaaggacccgggcattagatgggatcctgccagatgtcagaacaaaggaggcctcttctttggggtaacatctcttttttccctcagcctttccaaagtgtatctgttgtacttatcttttccagtgtagctttgggctttgttggtcatctctactgttttattatggtgggtttttaatacttcattaatttttctggttttatctttattaatgttttcctccgacgttctttattttgttcatttctggcttctggaatttaatgcttcaacatttatcaactcattggccgatctcatttcatctatacctgtacccactgccctcttcctgttttccttcaaagctaatcccagataccatataatttctcctgtaaatatttcagaatgcatctctaaaacataagtacacttttttagaaaagcattaccttagtatcaatacctgaaaattaacaataattatttttttaatctgccaagggtctgtcattcaaagaattctttaatatcattaatcattctttttgtttgaataaatgcataggaggctatagctgtgtgttctttcatgggtacactattgattacacacacagatgtgaaacactgtgaatatattcagtgcattcttccttattaacaaacgtgtgtaaacaaacaaacaaaaagaacatgtccatgcccttggatctcccagctccccatctctcagtctctgaactccagcagcagggagacaaactggataatccttaaaatactgttgtgaagacaaggaaagcagatgatctaaaactaagtagttaaaagaaacaagtaactttgttgtattggtgattcagtgagttggctcttcagaagggattttgtgtgcattgacctggatctgtactggatttctccagaaaggaaacttcagcttatcttgggtgcccccttatcctgctcagcatgagacagagcaccctggggcccctggaatctcaaagtctactttctagaaattcattgaagtctcttattctctgacatcctttccactctctctttctgggttgctgtttgtttacaatttctttactgtattttgaatggggtagtaggaggttgaggaagtaaacctgtgctatcaatccaccatttaacttgaaggtggttgaacttattttgaatttcccttctgttttctttttaaacttagcttgagtgctagttctgctgtttattgactttgatggctctcttttagagtcagctttcttcagatcttttctttcttcctgtcttccccaatgatatttttttcttttcctttctttttttttgagacagagtcatgctctgtcgcccaggctggagtgcagtggcccgatctcggctcactgcaacctccgcctcctgggttcaagcaattctcctacctccacctcccaagtagctaggattacaggcacgcgccaccacgcccagcaaattttttgtatttttagtagagacagggtttcgccatgttggccatgctggtctcgaacttctggcctctagtgatccgcccaccttggcctcccaaagtgctgggattacaggtgtgaaccactgcgcccagccctctggtgataatttttatgtcctactgtgtttctcttcctctaatgattaacttactaaaagtttagaaccaagatttatctatcaatgtcaaaaataaaacaatcatcctccacctactcaacaccagagcttttgcttgtttttattccccaattccaagctcttttccctcaattttaagaatctttctatatcacttgcattaaatttcacaactacattatcaacccattaaaatgtgactcttaagtttgtctagattcaatgcataccactatttcttgcatttccctaaaaaagctgccttagatcctctctggaacaaagcagggggtaaatgaccagatagaaggatggatggatgatagattattcattttgctttccccagtcagaattaagccctcccatggccccttgctgggctttctgtcaaaacacgtgcatcgcatcttttcagtatctgttttgcgtgtcggtcatactcacccctctgagtgctcattctctcgcctataaaatagaagaagtagtagaggtggcctgtaaggcattggggaggaggaactgccctttcactggcctcatgacagccccagccagcacccccgctctagttccacccacagaagcaagtctcacccctaccccccaggtctctccacttcctgctagagaatcacccagctccccagcctggcttgaggctcttttcagccttagctggctccccgcagctaagagccccatgctccatttgggcctccagtgtcacagggtttgacctgctgttactactacctttgtcataggggcaggtagtgggcggacatgatctagagtaccccacagagtcaggagcccccatgatctgagatagaccctagagctgagcctgaaattgggtgggcactgagggggcagcgatgtttgctgagggagaggttctggtgagagactaaatgaatgagcgagtgaggtaatggataaataaagataagaatgaaaaaatggtaagatgattaaattggtgactgaatgtaagggtaaattaatggaagaatggattcatggattaaataattaatggggaaattaatgaatgagagaatgaacgagtggttgaatggggaaatgagtggtagaggaaactggcaactgttgggttgggggtgtctatggggattgacttctccaactctcttacctctttttcttctgcccccagtgtcctctatttctccatccaccgctacgagcagggtaggttctggccccacctgaaggcctctaactggtccaccacaggtttcggccaaggccaaggatataccatcaatgtgccttggaaccaggtcagcatctacccacctctgcccccaaagtgaggcccagccccgcccttctgtcagcggctcgggacaggtggctgaacatcccccatcacactcctgtgtctgcaggtggggatgcgggatgctgactacattgctgctttcctgcacgtcctgctgccagtcgccctcgaggtcctggggatctggggtgtgttgggaggaggagtggccttgaaggttaggctgtgagggtaggtagcctcatggagtctgttcccccttcagttccagcctcagctggtcctggtggctgctggatttgatgccctgcaaggggaccccaaggtaaggcaggctccctggggcggcaggtgggttgcatggagccaggctgaccctccatgtccccccagggtgagatggccgccactccggcagggttcgcccagctaacccacctgctcatgggtctggcaggaggcaagctgatcctgtctctggaggtgagtgactcaccttcgtccctcagcctgtggatcctggagggcttaagaacgaagctttcaagtccaacaggagttcctggcccaggaattcacttactagctggacaaccttgcataagtcacttcacttctttgtgcctccgctttccttctataaaacgagcataatgtaatcacctcatatcattgtccagtgaattcagtgaggcacccttctaagttccttgttgcttgacatgtggtatgcactctcttattatcatcattattattattccctggtcatgtctggtcctttcctgatcccccttcacaactccttgccccagggtggctacaacctccgcgccctggctgaaggcgtcagtgcttcgctccacacccttctgggagacccttgccccatgctggagtcacctggtgccccctgccggaggtgagccccggtggaggaggggaaagcgggagcctcactgcccgcccacattccttgacatcatattttctccctgccctgcagtgcccaggcttcagtttcctgtgctctggaagcccttgagcccttctgggaggttcttgtgagatcaagtaggaagtggggtgtgggcctggtgtggggtggacgtgggatgagccctgggggagactgtcttcagacttcctctgactttactgggctgccttggtgggagagggtcaggccctctctctctccctgggccctggtttcaggcctcccacccctttttctgtttgggtcacctgagttccagagtatgacggggattcagattgagagggtaggacaaacgtggcctcccccttttagctgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacaggtaggcatttggagggctggatgagtaggtgttgggggtccctccccctcaggcactaagcctctacctctcgtttccccactgctagccaccaccctgaggtaccccagcgcatcttgcggatcatgtgccgtctggaggagctgggccttgccgggcgctgcctcaccctgacaccgcgccctgccacagaggctgagctgctcacctgtcacaggtcagaccccggtgcctggggtgggtggattcccaggactgtggatgaggtctcaggggctggaacttgggtttcccctcctggggagctgctgcaggacttgagaggggctgaagtccctgtcttaggggtggggaccagggaggggacagaccctcctcactgtcctgcgggtgctcctctctgtgcttccagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggtgtgtcctctgtgggctggggagaggaggacctggggggaatggaaaaagagagccatctgctgtttctggaggctctgagagagtcaagcagggcctgaggaaaggggccatggggaggggcacgggagggggtgggcctagaggctgggggaataatggaaggaactggagaaagggaagggtggccaagtgcagtggctcacgtctgtaatcctagcgctttgagaagctgaggtgagctcaggaggtcaaggctgcagtaagccatgattgcaccactgcactctagcctgggcaacagagtgagaccctgtgtcaaaaaaaaaaaaaggtccgggcgtgatggctcacacctgtaatcccagcactttgggaggccgaggtgggcagatcacgaggtcaggagatcgagaccatcctggataacatggtgaaaccccgtctctactaaaaaacatacaaaaaattagccgggcgtggcagcaagcgcctgtagtcctagctactcaggaggctgaggcaggagaatggcgggaacctggcaggcggcgcttgcagtgagccgagatggcgccactgcattccagcctgggcgacagagcgagactccgtctcaaaaaaaaaaaaaaaaaaggaagaaaggaaggtgagggcaggctgtccgatcttagcaccctgctgcttcccaggttctgaatggtgctgctgtggtgcgtcccccaggacaccacgcagagcaggatgcagcttgcggtttttgctttttcaactctgtggctgtggctgctcgccatgcccagactatcagtgggcatgccctacggtaaggactccctggggaccccccaaatcctgatccttgtggggacctggatgctccccccagcccattgtttactcatgccccatggtccagctcccaggacttccttccccagaaagaagtaagggtgcagtccttacccagagaaggaccgaggatggagcctctcagtgcttatttagataggacccccagatcatgttacctgggcacttacaaaacaggatccagggtcccaccccagcatttctggcctatagcagctgcctcgacagaacccaggtctaggctcctgatgcatactccagaagacccacgaaccagcccccagcattagctgcccaaggcccagggtccagttccctagcaatgacccagaagagcccagggcccagccccgagcacttgctcaggcctaccgggcagcccttgggaaccaggatcagacttttctccttaactgataggacccagggtcctgccactcagcactaaatgcccctgcagaccccaggggtctagcccagccctcttccagggcgtgagtatcgtcggttactgaggtgctgtctcctccccaggatcctgattgtggattgggatgtccaccacggtaatggaactcagcacatgtttgaggatgaccccaggtaagggctgcagtcaggggccgcagtgtgatcagggaggcgggtgagcacctcaggggtactggagcccctaaccagccatggtccgcttcccaccccctccctggcagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgaggtacagctcaggatagatcgcaggacgtatgtgacacgcctgtgcaggtggcagcctggacctgcctccttggcatgtgtgtgtgtgactaccatgtggctgatgatatgagacagcgcatgggtgtttaatgaggctaccagggcagttggtggctgtgatcaccttgtgtatttgtgcacagatggctgtacatgactgccttctctgtgtgacactgtgtgagtgactgtcttggctgtgtgtgtgagggccttctgactatgcaccaatggcccgtgtcctggctggatctgtgttgtatgtgcgtgccatcacaagtgcttgagtatgtgcgtgtgcgactctgtgcaggcaggtatttctcaccttttctctgtgtgatgggtgtgatactgtatgtcactaaatgcaaccatctctgtgacagcctgtgtgggaccttctggatgtggaaggctgtgtgtgacagcagtcactgtctggctgtctgccctggctgtttgtgtgtatgtctctgactgggaggtagctgccttccctctgtgtgagctaggaggctggtggcttgtgtatggctgactctgggagggagggaaagggtgtgagcaccgctctgtcaccctgggcgccggtgtgcatctttggatctgcatgtgcatctgactgtgcatgggtagccaggacagccttctgtgtgtgtacaactgtatgtgcaaataaccagctcttgtggacataccagagtgcatgtcgccgttgtggctgtgtggtgatggcatgtgtatgtgactgtgcaggatggctgtgggttattgtcctctttgagaaactgtgtgtgtgtacatgactagtgcagatatatagtactgatctatatggtactgtctgtgtggcagtacgtgtggctctgtgtgaccatcttctctgtatgtggttcttgcgttgccatcttctgttttggaagtgtgcaagcacctctctttggcactatgtatataaaaccctgtatcttgtgtatgtgtgtcccacgtttgaccctggggtatgtgtgtgtgaggacatgtctctgtctctctgtttttcatgtcactctcttgacgtgtcagtctgtctcatgtccccatctgtccctttttttttttttttgaaatggagtcttgctctgtcacccaggctagagtgcagtggtgcaatctcggctcactgccagctccgcctcctgggttcatgccattctcctgcctcagcctcctgcgtagctgggactacaggctcccgccaccacgtctggctaattttttgtatttttagtagagacagggtttcactgtgttagccaggatggtctcaatctgacctcatgatctgcccgcctcggcctcccaaagtgctgggattacaggcctgagccaccatgcccggcccccatctgtccctttctgccatctccatgtctctaagtctgcatctatttcttctacctctgagtctgtatttcttttcttcccttcttcattttcagtctctgcttttgtgtctcctagtctccaggttctgtgtctccatctctctgacttgcatctccatgtcttcatttgtccttttctccatgtctctgggtcgccatcacttactgcctaccaaaagcccctaccctcatgcttatacatctcttctctccctgcctcagtttaacccagaactggtgctggtctcagctggctttgatgctgcacggggggatccgctggggggctgccaggtgtcacctgagggttatgcccacctcacccacctgctgatgggccttgccagtggccgcattatccttatcctagaggtaactttctcttggtccctcttcccacagtgggagggtagtttggaaatgttggcaccatcactcaggacagtttcctgaaatctcctttgagtgtccctgcctgggattgttggcacatactgggtagtaataagaataacagcaacattaacagccttaattgagtgctcactatgtgcagagcactcttctgagcacctcatgtgtcttattcattcagttacttggcaaagcagccttatgaggtagggtaagcttacctcattattttcctctctgaagatcagggaaactgaggcacaaagaggtgtgatgactagcctgagatggcacatttactgatggcagaaccaggacttgaacccatgcagcctggctccagggtttgtgctttttactctacctgaactgcctctaacaagttcctgggacaaaggaaattcactgacctttgtaaatgactcagtatccccacgccctgtgcctcagtttcctcatctttatgaggcaggctaatcatggaggaatgcctggcatatggtaaatgctggatcttttggatctggttttttgttgttgttgttgttgttgttgtttgtgagacaagagtctcgctctgtcacccaggctagtctgcagtggcatgatctcagctcactgcagcctccacctcccggcttcaagtgatcctcccacctcagcctcctgagtcgctgggattacaggcacccgccaccacgcccagctaatttttgtatttttagtagagatggggtttcaccatgttggtcaggctggtcttgagctcctggcctcaagaaatccacccaccttagcctcccagagtgctggaattacaggcatgagccaccgcacctggcccctggttactgttatgcgttgttcagatattaacccactcagcaaccttctgtgctcttattttctttttctttttctttttttttttgagacgttgtcttgctctgtcgcccaggctagagtgcagtggtgcgattgtggctcactgggttcaagcagttctctgcctcagcctcctgagtagctaggattacaggtgcctgccaccacacccagctaatttttttgtatttttagtagagacggggtttcaccatgttggccaggctggtgttgaactcctgacctcgtgatccacctgcctcagcctcccaaagtgttgggattacaggcatgagctaccatacctgcctctttttttttttttttttttttttccttttgagacagagtctcgccgtgtcacccaggctggagtgcaatggcgctatctcggctcactgcagcctctatctcccaggctcgagcaagcaattctcatgcctcagcctcccgagtagctgggactacaggcgcatgccaccacgcctggctaatttttgtatttttagtagagacgggggtttcaccatgttggccaggctggcctcaaactcctgacctcaggtaaccttcccgcctcggcctcccaaagtgctgggattataggggtgagccaccgcgcccagcctgtgctgttattttcaccactttacagatgaggaaaataagtcactgagaaattaattggcttgcaaaaagtcgcacttactatgtgcccagtactgcttgtgacaggacacggtgggagttaagaacacagatgactccatcagagagcccaagttcaaaccccagtgctgcctcttcagctgttatgacctcggacaagtcatctaaccactctgagcctcagtttctttatctgtaaaaagaatagcaactgggattcctgtagagtgtaaaaaaagtcaatacaggagtccatgtggagaaagagtccagttgttcctgtactaggtcagggcaggggcttttgtatgggttcacagcagtcgtcttgtgcaggtcaggtcagtggttactgtatgatgtgaggccaggggttcctggacagtgtgaagacggatttctgtatggcatgaaggcaagttcctgtatagattgagcgcctgtggttgtgaggattgagttaatatgcatgaagtacttaaaatcgggtctggcacacagcaaacaataaatgtcagctgttactaatgcttttatcagtattgttatcttgcactttacatcacaatttactccccacaacaaccaccttacacagtgggtgctgcctatcttaaaggtgtgggttctgttcacttgttctcagtactccccctccctctccagacttgcagggctcagtagggaggattggggaggcaggacatgttgtcctccaaattccccaatgaacccccaccatacctttccctccccttttccttaacaaagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgagtgagtggatttgggggtgatggggggaacccagggaaggagggggctgaggggcagagatcagaggcaggaagggtgacagtacccacactcaaggatctccctccctggttccagaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcaggtaaggctcaccacacccaggtaggggcaagaaggggcaagaatcgggcttctctgatacatctcttacttctgcgtgtccagggggcctcagaatctcaggccccaggagaggagaacctactaggagaggcagctggaggtcaggacatggctgattcgatgctgatgcagggatctaggggcctcactgatcaggtgagctcagggagaggctgggactgtggcttccttctcttgccaatttgtgtctccaggtaggagcatgtgatgaataaacatataatggggagatggggtcttcagcttacctagtttcacccacccactccaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtatggagcagaggaaggggatggggcggaggttggcccgggagcaaactgcagggggatgctgacccccacctgacactcacacccccaacctcaggtctactgtggtcgttacatcaatggccacatgctccaacaccatggaaattctggacacccgctggtcctcagctacatcgacctgtcagcctggtgttactactgtcaggcctatgtccaccaccaggtgggccctgggtagacccttcgacacgtgcacactcaccccccacacacacaccccttctgtgattgggtaaagggagaccacaggcccctctgcatggctgcctcatgtgattattttgcatggggcgggggctgtgggatagtccagaagacagagtggttgagggctggagtgggggcagccctgcagccgaggtagaggggtcctcactctctctcacctgccctattcttgcctcctcctcaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaacctggagaaagctttttgactttgagcaggtggagaaccccacatccctggccagcagagccgatgagtaatgaaggaatgagggagtgggtctctgtcaggtcaatcccctgcccatccattgcccccaaaaaactaactgaaaatagagcagccatcttgactggctccacgggatataaaatggtagaatccatgagaaaatgggtgcttgccttataaataggagcctcacagccagtcccagccacacccacaccctaggctgagaaggcaagaaaactagcaggaagtatccttaccaggcctgtttccccactgtctcattggcctgactggggatggtgggaggtccaggtttaacttgaatgtggtggtcatggtagcttcttggcagaaggggtgcctgccattgaccacaggtgggaaattggaggacagtctgagagctgaatttctcccacgtggtgagaattgctttggcagctcaagggagttggatctgaggtttccaggacttttcttcatggccaccttatgatcccaagctgaccaccacagccttactgagtcaagaagaggagggatggggaagggccggggctgccccgttcttgttttgttttgttttttgagatggagtcttgctcttgtcacccaggctggagtgcagtggcacgatctcggctcattgcagcctctgcctcccaggttcaagtgattctccttcctcaacctcctgagtagctgggattacaggtgcctaccaccacacctggctaatttttgtatttttagtagagacggggttttgccatattgggcaggctggtctcaaactcctgacctggtgatccgctggccttggtctcccaaagtgctgggattatgggtgtgagccaccactcccgggccaggggctgccctgttttaagagccctctggatgccccacctctgctgccctctcattgatcaggactgtgcatgtggttgccatagctgcaagggagcctgggaaatgtgtagtttgacaggcagccgcctccaatcagggtctttcttccctgacagaatgacccctcctctgtcactgtcttttctccagagctaccaaaaaaccgagttgaggcagcacaggctctgtggcctgaaagagcttcccacaaaaccgttcccaaagtcaggccatcctggtcaaaatctaacacccaactctcccacacacacacaccaccaacaggaaagcaagggagaggcgccacaggggacacacggggaggtttggccgccgtccgtgcacccctagaggccgctgtggcacccacgtgcctgtgcgcaagccgcctgggggggcacgaccccttgctcccccggggcaatggcacgggcaggggcggggcagtggcaggggcaggggcgcggcgcaggggggtgggcggcctgaggagccgagggagggcggctgcgcatgtccactcccccaaccgccgccggggtgccccggggagcagcgtcgccccccgccaggcctgtcagagcgtcccagcgcgcccgcctccccacggacacaggtgagcgaggcgccggtgcccctggccctgccaggcctgggggtatccccgcgccggctttgggggatcgtcccccaagcgccaagccttctcccgggcgagcggcccctcactcgggccggccgggaggggtgtcggcgcttggctggaagcggggccgcctcacccggagtcgggatgggtcttgacaggatgcccgggcgacgctgctcacaccgagcccgaagtggagtcctggtttcggggacccttccgcactccgagctttgcacctcacccggcctcgtccgggaaagcacgacctggcgaggccgccctaaccccaggtcccggccccttagcgcgccagccttggtgagctgggcgaagccccccaacctggtcccagcggctctgagcgcgcggccacggggacccgccgggggctccgcgccacttgagaggaccgagcccccaatctccggcgcctcccgcgggctgaggccccgggccagtgccctcggcacgtgcctctgcgcctcgggctcctcccgggagcggagccttggggaccagggccgcggcctccctgcgcgtcgcggggactgggcgagtgtggccccgtcccgccaggcacctggggtggaagctgcgctccgccactcggccaggccccgggctttccttcctcaccgtcggcgcccccagactccagccgctcagaccccgacttaagaggcagcctcgaccccgcctctgccttctgacccatccctaaagatggccgggcacccctacaggacccccagaagccgacctctccctccacgtgcgccgccgcctcgcccctccccgcagtcctccaggtcttcttcctgtccccaaccgtcggggacccccaagctccgtcctccgcttcctgctctctttatcccgcccccgctccttctgggccaacgccgccagtgactattcccagggatccctcagagctgaggacgccgcggccgcatccccatttgggaccttgccccgactccgacctccggatctccagctccaccaaacctcgaagccaccatccgcccccaaactgccgctgcgccaggctttcggaggggagtcgtggcaacagccattaggatgcactaagcagggcacttcctgagcccaaggacaccgaggggcattcactgagtgaatggggatgtgctgctaataactaacactaattgaccacctgccgtgtgcccatcctcttcgaacatgcaacttccttgttccttatcttgttactgtctctttctctctgccagaatccaatcctcacaagggcagggactggggtctgttttgttaactgccatatcacaatgcctggcacgaaggaagattcttgaattaatgaatggagattaaattataatttaaaagcctggcatgaactgagcaccttctgcatgcttatcacccgctactgacatatagttcactttttttttttttttttttttgagacggagttttgctcttatctcccaggctggagtgcaagtggtgtgatctcagctcactgcaacctccgcctcccgggttcaagcgattcttctgcctcagcctcccgagtagctgggattacaggcgtccaccaccactcctggctaatttttttgtgtttttattagagacagggtttcgcaatgttgggcaggctggtctcgaactcctgacctcaggtgatccacccgactcggcctccaaagtgctgggattacaggcgtgagccattgtgccccgccccctttttaacctagtttgttgtctctcaccccgaccagaatataaccttcatgagggctacagtttgttgtctatttattgcccaactccatgtccttgccacacagtaggttcccaataaatgtatgttgaataattaataaagactacattctaatgataatggctaacagaccacgtgatttacatatttatttggtttattatattatctgcctctgccttttagaacataaaccttctgggggtgggaatgttgggtccctactgtctggcaggcactgtgctgggctagggttcaatggtgaccaaaaccggcaaaatcctgccctccctctgtcatggggaggaactgctaatgggcatggggattcttttctgggtgaggaaaatgttctaaaatttacttatggtgatagttgcacaacttcgtgaatatgctaaaacccgttaaattggacactagctggctgaacttgatgggatgtaaattacatctcaataaagctgtttgggaaatccagccttcacagttgttgattcgcgtgaggagggaaggagagatggggggacgtgggacagggagaaaacaacataaatcatatatatatagcatgcaaattggaaggtgatcagcacacaataggcattcaataaatgttgaaataatgacaccccactgtctccttgccctcaaatggtctcccctaacgtatcccctgttgtcttgcttcttctcttcccacttgcagagcctgctgcccacgtctcttccctgagctgcctgctggggtcatggagctgccaacaaagcctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtgattgttcatttgacatgagacccctgaggcaactagctttgagggacacatcaggtatactagggaaagatggacatctctcttgttttcacttggtgaggggctttttggtaacatgggagtgcctaatgttgcttttgttatgtcaagttgaaagattttgtgcaaaattaaataaatggtgttttgggtttcaaagctgcctccatgccgagtgttgtgtgggtgggagtgagactgggtagaatgttacttgagttgtgagaattctttcattcaagaaattcagggggagcccactgtgtgctaggctccgctttatatataagggaggtagaggcaaacaagacacttaaaaatccttgcccttatagatatggcatcaggctagatagtgataaaggctacgtgttaaaggcaggtgaaggaatagggtgacaggtccaggaaagccttcttgagagtaggtgacatctggacaaaaacctgaagatatccagaggcagagggactagccagtgcaaagaccatggccacaaatcagctgccaccacagcaaccctcagtatatccagggcctggagcaagagtacaggtaggcctctacactacataactaaatatgtaaacgttcagacattacgaatcaagctttacaaagtaaatgaaatacaccctatcctactttggcaaatacactttattagtgacctggatacccaggctccaatttctcagccttctcagagttccctgccagaatgtgcctgtctgccaaagagtgtgcctgtactggggcctcccgaccctcagtgccctctccctttctctccgctctctccttttctcttccccacatcaggaggtgttcatgtgtgcctgcgacatcccagccagcacctcaagctctactcacgtgccccacaaagccaccccttggccctcaggaggatggtcccttggaagatgatggtgcaggccctgaaagtggcctcaaagcctgggatccccatacccaagtgaggcctaaaagggggacacaagatccgcgattgtccatgtggatgtcttcccctccacccctaggagagacatagactgagcaggtgattgctctaaagtgcaggacccagggtagagtctcctctctcctggtctaagggcaaccaccaccgcggggaaccaccagcccctagaaactgccactcacacagacaagcacagagctgcttcagatcatgtttattgtggggccagggggtagggatcctcgggtgagagggctggctggccggggtaagttgctctggacgtgctggcggggagcagtcctggtggcgggatggcgggggcacttctgggtcccagggtgcacgggatccgggcagtgctcagggtggcaagaggcggcgtgcaggcacctggggcgccggggtctctaggcgtttcacacgcagcagcgcccccagcacgccctcagggggcagctcagagcccacatcgtggtcggcggcacggcggaggcggcgcggggctgccaccccctcggagtccgcgcttcccgcaagaatccgtcccagcaagtacctgcagggccgagcgcaaagcagtgaggcggtgtccgcggtggggcgttcccccgccccacgctcggggcccagaacgcaggatccacaaccacatactgcctggggacacggttccctccccaagaaggcgtcctcagcccactgctttcagtagacagccgtcatcgcctttcatcccagaaaactgtggcttccccgcctccctctccccttcccaggacctggggtccacttcccccactgagtcagccaggcatccttgcctggactccctggatccaggacctcactccctcttaggccccaggacttaggggttcgcactccacggggtaagcaggcttcccagttcctcgccctcgtcctctccggacgcaggcgcccgacccctccccaccccctgccgggcacctcaacagctcggggtccacgtcgggtgtctcgtcgcctgcctcctcagcatccgggcccgcggggccgtcgtcgtagaccgggggccggggtcggagcgccgcggcggggacgggcgcggggacaagctgggctgcgagggcggcagggtcaaggcgggcgcggagcagagcgcgagcgagctgcgctgcaggcgcgtcggggtcgtcgtccaggcccagagccggatcagagttgcggggggcgccccagacgcgcagcagctgcgccaggacgcgcgcctgctgatcctcagcctcctgcgcctcggcccgcgcccgctcctgacgttcggcctccagcagatgcgccagcgcccgcgccagctcctgcaccgcccccgccgcctcacctcggggcactgaccgccggaagcggcgaggagcgccagtctcagccaagggcggagacgctgcgcttaggccgcggggctcctgcgggaaaatgaggtgggggaaaagagtttgtcagcgtccgtcgagacagggacccccagcccgggaagcttcgtaggcctcaaacatcccagatgccaccaaaagcaccgtgaccatccaaatatacccggacacccctaaggccactggaaaccaccaaatatctccagacgcacttaagaccaccaaagatccccagacaccccccacccccaccccacagcgcgccagtgatcccttggtgactctcataattcctccctccccacccccactcctggagaccgagtttcttcataagagtagtgatggtagatatgacagttatagatttttccatatttaatattgtggacaataggaactatatgaataaacttgttcatatatcatttggcatgtgtacaagttcatctgtagaataaattacccaatgacaaattttcagttcaagcagttttcaaacaatttccacaagtttaaagaaataaaagagggtaccaataatctgagcaaggaataaaagatcataaaaatgactgtgaaggtttggaaaagaaacatacaggccacatataaatatgtttaaaaggagtgatgcctgcaacacaaatagtcaatgaaagagtagtacacagaagatacagagaattcctaaaaagtagtaagagaaaaacaaactcatacagaaatagaaaaaatacatgatcgcctatttcacaaaaatgattactaaacatatgaaaaattgggccaggtgtagtggttcatgcctgtaatcccagcactttgggaggccaaggcaggaagatcgcttgaggccaggagtttgagaccagcctggtcaaaatggcgagaccctgtctctacaaaaaataaaaccaaaaaaaatgagcggggcacaagcccatagtcccagctacttgggaagatgaggtgggaggatcacctgagtccagaagctcaaggttgcagtgagcccagatcgcaccactgcactccagcgtgcatgacagaggaagaccctgtctctaacaaacataaaataaaattaaaaacctcattagtaatcaggggaaagcaaattaaaatgccagggagatactatgcataatataaccaaaagattgacccaaatcaaaaagtctgataatatgaagtgttgatatgaatgcagaaaaatgggaactctcatactatgctggtgagaattaaactggcaaagtaattttgcagagcggtttgacaatatctaaaaagatgcacatatcctatgacccactcctgggatgtcactccccagagcagctttggcacatacgctactggtcacaagttcgtgaaagatgacagcagcactgttcgtaatagcataaaagggcgggggagaaagaaaagcctggaaacagtccaatgtccactgacaaattgagaatacatatataaatcatgatgtcctcataggatgtaatattatgcagcaataaaaataaatgaattacagccacatgcatcaacttggatgaatctcgtgaccagaatagagccaagggaaaaaaaaacgtcaagttccagaatttcactgcagactgcctgagactactagacaccctgaggacttcctagtgacccctagtgactacgaggaaccagtcacccagtatgattccgtttcaatgatgttcaaaagcaggaaaaactaaacaatggattttttttgagagctacacatatgtgataagctacaaacaaaagtaagggatcaatggacagaaaatacagaataaggactgtggggggacaggggctgccatggcgaggggcacgcaggggcttctaactcttggtcaggctctatttattaagctgagtgactgctacacgagagagttattttgtcatcattctttacattgtacatatatattaaacacattgttacacggatataaggtaacagttttttttaattcccatctttgatgcagacagtattgaagagctagaggaggatgcctctccaagtgcccttgctggcgcccaccactcctcagtcaccccggggtatcacactcaccagcaatcacagcctcacacacactcatgaggactgacaggcctggagatgtcacatatacagcccaacactgccacagccacatgcaaggacctgcacacgttcacatccgcagctgctcctgcagttacaatcgccaagccacccaggtgcaaggacatgcaccatccttaaagacacaatgcagcagagagacatcatggctcctctcctcaggatgacacagctccacaaagaaacggagagaaacagtctcaggaacacgcaaacgaaatcccaggcacttggtccaacagaaccactatggaatgtgcacacggagatgcgaagaccattccctctcaaacacaaacgaaatcacacacacacacacacacacacacacacacagagagagagagagacagagagagagagagagagacacgcccataggccaagccaacacacataataaggattcacaaatatccacacggtgtcactgagaaaacaatcggacgcacaaaagaatcgcgcacagaagtatcccggtatcacacacactacacacccagacgcaccacggcacctttctaggacacttggaagcgctcaaaccaaagaacacacactttcaaggacacgacacctccacaccgctctcctcacatcacacgcacacacactgatgcgcgcgcgccctttcttaaagcgccttagtgccgtggacagcgtcacaggcaccgggcacggagaggtgggcagggcacggttaccggcggcgccccggacaacgccacccgcacaggcagagaccaagtcaggtctcaggtgtgccggcgtggcctgggcgcggaccggcggccggagcccgggccaccctcgtcgatctctccgcacgtcccgggagccggctcgggcgggggtgaggcggcgcagccccaaccccaaccctcgccggtggcatcctcccccaacccccacccctcgccggactggggtcgcacctttaccggccgcgcgcagagcgcggggggcggccgaaacaggccgagcagcagcagcaccaaaaggccgacgcccccggcccgcggcccccagagcagcggcgaccccgccatgctgccccagcgagccgggctccggacgggcggactggctggcaagtgcgcagtgccggggcgagctggcgaggctgcggcgctctgcggctgcgcacgcccggaaccaggccccccctccccgcccccaccccacccacccgaccgacgcaggcgcagcctggggagctggcagccccaccagacctcccgtcgccatggagatgcccaaagggcaaggtggagagctggcggttgccatggcagtcggagggcagttgctggggcaaccgaccttactgttaccttagtagacaggaaaacaggtaagaaaaattgactcagtggagtggaatgggggtctggtcctcatctctcttcctgggggaggagatggactttagtttgttcattagataaatagttaatggatcacccgcagtgggcccggcccgcgccagggagatgggttcaatctaggtgatgtgaccatggacagctcagttggccattctaaggctcaggctctcagcggcgtaaaggggttactactgacagcctccctcaaagtgaccttggaggtttagaatgacattcagtaggagctccataaatgctcctttccatcctctccttgtctctttgtgtttttttttttctgacagtgtctcgctgtgtcctccaggctggaggacagtggccggatctcagctcactgcaatttccacctccagggttcaaccaattctcatgcctcagcctgccaagtagctgggactacaggtgcccaccaccacgcctggctaatttttgtatttttgtagagatggggtttcgtcatgttgccaggttggtctccaacttctgagctcaagcaatcggccctcctcggcctcccaaagtgctgggattacaggcgttgagccaccatgcctggccccagcccaatactttcatctctccatggctctctgtgtttatctttctgcccttatgtgcccacagctctctctgtgtcttcctctccccatatgtctctccttgtctatgactttctctcctttcatctctccaaccgctgtcttgtctctgtctttattttactgtctatatctacttgttttccatagatagatatatacatagatacatatatgcatagactttacccatatattgttccagaaataagttcaagccactaaaatgacatatcaaaggaaacaagatcttgaaaaaatgtatgtgtatccatagggggaaaaatgttggggaggaaatgtcatcaatggttatctctggggaggtaactaatggtttgttactttctcctttatacttttctgttgtctgaaaaaaaaaaattacaataggccaggcgcggtggctcatgctcgtaatcccagcactttgggaggccgaagtgggtgtatcacctgaggtcaggagtttgagaccagcctggccaacatggtgaaaccccatctctactgaaaatacaaaaattagccaggcatggtgacacgcgcctgtaatctcagctactcaggaggctgaggaggaggagaactgcttgaacctgagaggcagaggttgcagtgagctgagatggtgccactgcattccagcctgggcgacagagcaagactccgtctcaaaaacaaaaaaagatcatctgaataaatgaagacacaatacatgttcctggatgaggcaatttcattttataaagatgtcaagtctatccaaactaatatataatttctatgtaatttcaatttaaaccccagctgaatattttaaagaaaatcaattaaatgtactttttattttgttttatttttaatcctactccttctgtaataaaatgtgtaataaaatttgttttggtttgtttatttgtgttttgagacagggtctcactctgtcacccaggctggaatgcagtggcgaaatcacggctcactgcaacctccacttcccaggctcaagcaatcctcccacctcagccttccgacttgctgggactacaggtgttccccaccatgcccagctaatttttgcatttttctgtagagatgggtttcaccatgttgcccaggctgctcttgaactcctgggttcaagtgatccacccaccttggcctcccaaagtgctgggattacaggcatgagccaccacacctggccatatttttaaatgtatataagagtccatgcaaaaatttgtacacaaatgttcaaagcagcattatttataatagcaaaaagtggaaacaacccaaatgttcatcaatagatgaacagataagtaaaatgaggtttctccatatcattgaatattattcagccataaaaaggaatgaagtgaggccgggtgtggtgctgtaatcccagcactttgggaggccgaggcaggcggattacttgaggccagaagttcgagaccagcctagccaacatggcgaaactccatctctactaaaaatataaaaattagcggggcgtggtggtgcatgcctgtaatctcagctactcaggagaatcgctggaacctgggaggtatgggttgcagtgagcagagatcgcaccactgcactcctgagcaacagggagagactccgtctcaaaaaaaaaaaatctcatgtatcccataaatatacacaccatgtacttataaaaattaaagattaaggggccgggcatggtggctcacgcctgtaatcccaccactttgggaggctgaggcaggtggatcacgaggtcaagagatccagactatcctggccaacatggtgaaacctcgtctctactaaaaatacaaaaattagctggcatggcagcaggcgcctgtaatcccagctactcgggaggctgaagcaggagaatcgcttgagcccgggaggcggaggttgtagttagccgagatcgcgccactgcactccagccgggcgacagagcaagactctgtctcaaaaaaaggaattaaagattaaaaacatttgatatgcatggttgattatcctaggtaaaaagaattacagataaatacaaatatgtatacatgaaaatggatatgagttttatttgtttattgaaaagttataggggcgaggacaaaagactacaaaaattaagaaataaaaataaaaagttattacagcttattaatggtaatattataattaatacatacataattttatttatcatactaagttaattgtattttgaaactgtggaaaattttttaatttattgactatgtgtagattgactgacttcgagacagagtctcgctttgtcaccaaggctggagtgctgtggtgccatctcagctcactgcaacctactccccttgtgttcaagtgattttcatgcctcagcctcccgagcagctgggactacaggtgcacgccaccacatctggctaatttttgtattttttgtagagatggggtttttgccatgttgcccaggctggtctgaaactcctgacctcaagtgatctgcctgcctcagcctcccaaaatgctgggattacaggtgtgagtcaccatgccaggcctgtatctgtagatttatatttccatgtataactaactacatacatatacttatattaataaattctctactggaaattattacatgaataatgtacaaaagatgtaaaattagaatttgtgtccttttactatgaaataactaaattattgttttcctagttcagtggaggtttcttttgtcatcaaaaataatctatctctctgtgcttttcgacatattcttaaatcttttttttttgttgttgttgttgttgtttgagacagagtttcactctgttgcccagtatggagtgcagtggcatgatctcggctcaatgcaaactctgcctcccgggttcaagcgattctcctgcctcagcctcccgagtagctgggattacaggcgtgtgccaccatgaccagctaatgtctgtatttttagtagagatggggttttgctatgttggccaggctggtctccaactcctgacctcaagcgatccgcccgcctcagcctcccaaagtgctgggatcataagcgtgagccaccgcgcccggccacttaaaccattttttaaaagagtccttctttacctttttttttttttgagacggtctcactccgtcacccgggctggagtgcagtggcgcgatctgggctcaatgcaacctacgcctcctgggttcaagaaagtctcctgccccagcctccccagtagctgggactacaggcacgtgccaccacgcccagctaattttggtacttttagtagagatgaggtttcgtcatgttggccaggctggtctccaactcctgggctcaagtcatctatctgctggcctcagcctcctaaagtgctaagattacaggcgtgggccactacgcccagtaagtacttatttttgaaaaaagtttctaataaacgttgtttattgctttatgattctgcagtaattataaatatttcttgtgcttaggtatttatgaaatattttgactcctctaacaactctttgtaattctgattttcccaaattcagaataaaattggttagatgtcttttctatataaactattttggggcttattaaaatgattattagggctgggcatggtggctcacgcctgtaatctcagcactctgggagactaaggtgggagcattgtttgggccccagaggtcaaggctgcagtgagccataattacgccactgcaccccagcctgggagacagagcaagactgtctcaaaaacaaattaaattaaattaaattaaatggttattaggtaatctaaagatttctccttcaccttataaaaggaagggcaagagaagtaattaggtttatctagaatgcttcacatgtgaattaattcaaaattcttataagtgctctttggcttattaaacagatttttaaaaaactgacaaatcaaaaagaaaacttatctttctatgctaattctgcaaaagtaaaatatgttctcataagtgtattttaatgattatagactttttgtgtttaaaagaaccataattatgacacaatcaagcacaaatcctggtataagaactgtctacaaaaagatgtgtttccaggattctagatgcccgcttccctttttgttgatgatatgtctaaacaagtatcaggactattgcctcaattacctgggactctttggaggcctgttatttactttagttttcgattagatccaggagccaaggcgtagcctatgaaacattattgcttccccttcacacatcactagccattgctgcaacactctgcccctcctgaatgacctgggcgatgaaagccccttgttgcttacctctgctgggaaaccagccgcaccctgcgcacacttgctagagaccccctcagctctcctgatttaattgtgttgttggcagttcatactcaaaaagaaacactagttgggactcggtggctcatgtctgtaatctcagcgttttgggaggctaaagccagaggatcgcttgaggccagcagttcaagaccagcctgggcaacatggtgagactccatctccacaaaaaataaaagtgaaaactaatacgaactaaaggaattccactttttaaaaacttttattattattattattattattgagataatgtctggctgtgtcacccaggctggagtgcagtggcagtgatctctgctcactacaacctccgcctccagggttcaagtgattcttgtgactaagcctcccaagaagctgggaccacaggctcacgccaccatgcccagctaatttttgtatttttagtagagatggggtttcaccatgttgcccagactggtctcgaattcctaagctcgagcaatccacctgccttggcctcccaaagtgctgggattacaggagtgagccaccacacacagctctttttttttttttttttacttttatataccctaggagtaggtagaatttcacttctgagtatacagcaaaaagaattgaaagcaggaacacaaagagatatttatacacccatgttcagagcagcattattcacaatggccaaaatgtagaagcaactcatgttccttgatgaatgaatggataagcaaatgcgatatatacctacaataaaatgttattcagccttgaaaagaaggacattctgacacctgacaacatgaatgaagctcgaggacattatgctaagtgaaataagccagtcacaagacaaatgctgtatggtccaacttatatgaggtacttagagcagtcaaattcagagacagagtagaatggtggtttctagggtctcgggggaggagggaacggagtttatcacttaatgggtgtagagtttcagttgtggaaatgagaagagttctgcagatggatgatgactgtacttacacaacaatgcaaatatgccgggcgcggtggctcatgcctgtaatcccagcactttgggaggctgaggccgggagatctcttgagttcaggagttcgagaccagcctggccaacatggtgaaaccccatctccactaaaaatacaaaaaatagctgggcatggtggcgcatgcctgtaatcccagctactcgggagactgaggcaggagaatcacttgaacccgggagacagaggttgcagtaagccgagtgagactctgtctcaaaaaatacatatttacggccaggtgtggtggctcacacctataatcctagcactttgggaggccgaggcaggcgaatcacgaggtcaggagatagagaccatcctggctaacacagtgaaactccgtctctactaaacatagaaaaaaattagccaggcctgatggcacacacctgtactcccagctactcggaaggctgaggcaggagaatcgcttgaacccgggaggcagagcttgcagtaagctgagatcgtgccactgcactccagactggcaacagaacgagactctgtctcaaaaaaaaaaaatacatacacacacacacacacacacacacacacatatatatagaaagagagcgagagagagagagagagagagttatatataaattagttcatatggctaaattaattgcccttgcctagatctgccagctgacagaaaatagaaggtgcatttttttttttttttttgagacggagtctcgctctgtctcccaggctggagtgcagtggtgcgatctcagctcactgcaagctccgcctcccaggttcacgtcattctcctgcctcagcctcccgagtagctgggactacaggcacccgccaccacacccagctaatgttttgtatttttagtagagacagggttttactgtgttagccaggatggtctcgatctcctgacctcgtgatccgcccaccttggcctcccaaagtgctgggattacaggcgtgagccaccgcgcccggcctaggaggtgcatatattaatactgatataaacatatatgatttcgggtcagtccatgactttgaaatgttttatcaacaaaaggattcccagagcactacaggaacccttataagaatggacaacaaattaagaaaaatttgtatgccttattattactgagatagctactaatgaaatgagccaaggccaggtgcggtggctcacaactgtaatcccagcactggcccaggtgggcagatcacctgaggtcaggagttcgagaccagcctggccaacatggtgaaaccccatatctactttagaaaaaaaaattaggctggcagcagtagctatgcctgtaatcccagcactttgggaggcctaggtgggcagatcatctgaggacaggagttggagaccagcctggccaacatggtgaagccccgtctctactaaaaatacaaaaattaaccgggcgtggtggggggcacctgtagtcccagctaccagggaggctgaggcagaagaatcacttgaacccagaggcagaggttgcagtgagccaagattgtgccactgcactccagcctaggcaacagtgtgagaccctgtctcaaaaaaaaaaaaaaaaaaaaaagaagaagaagaagaaagaaaggaaggagccatgatctgagagctaaatggaccctgatactgaaccaacattgatggggtcactttaagggtattgccaggatggttcttccatgtcctacttcctccagtgacacagtcatggcaatgactataaaggtagaacatggataggaaccaaagacctgaggcccttttgaacacttccaagtgggctatgagtaagttctggtccttggttattttcagggtgaattgagcttttctttgctggagagccattgcaatacagggggaaactgtattccgacttagggaatcccaatttattctccaataaaagggacaccaattaaactggtattgaggacatcatgctaagtgaaataaaccagtcacagaaacacaaacactacatgattccacgtatctgaggtatctaaaatagtcaaattcatagacccaaagagtgtcatggagtcgttgccaggggccaggaggaagaggaaatggggagggctttttttttttttttttgagatggagtttcgctcttgttgcccaggctggagtgcaatggtacaatcttggctcaccgcaacctccgcctcccgtgttcaagcaattcttctgcctcagcctcccaagtagctgggattacaggcatgtgccaccatgcctggctaattttttttttttaagacaagagtcttgatctatctcccaggatggagtgcaatggcgcaattttggctcactgcaacctctgcctcccaggttcaagcaattctcctgcctcaacctcccgagtagtcgggattacaggcgcccgccaccacacccagctaattttgtatttttagtagagacggggtttcgccatgttagccaggctggtctcaaactcctgacctcaggtgatccactcacctcggtctcccaaagtgctgggattacaggagtgagccattgcacctggcccaaaatggggagttattaatgaacaggcataaaggttagtctcgggcaagatgaataagctcagccgggtgcggtggctcacacctgtaatcctagcactttgggaggctgaggtgggcagattgcctgagctcaggagttcaagaccagcctgggcaacatgatgaaaccctgtctctactaaaatacgaaaaaaaaaaaaaattagccgggcgtgacggcatgcgcctgtagttccagctacttgggaggccaaggcaggagaactgcttgaacccaggaggcggaggttacagtgaaccgagattgtgccactgcactccagcctggcaacagagcaagactctgtctcaaaaaaaaaaaaaaaaagaagaagaaaaagaaaaaaacaagatgaataagctctagagatttgttgtgcaacattgcatctagagtcaacaatactgtactgtgcacctaacattttgttaagagggtagatctcatgttgtattgtaccataataaaataaatttttaaataaaatcattggtaggctaggcgcgatggctcatgcctgtaatcccaacactgggcagctgaggtgggtggatcacttgagcccagaaggtcgagagaccagcctaggcaacatggtgaaaccccgtctctactaaaaattcaacaataaaaaaattagctgggcgtggtggcaaggacctgtggtcccagctactcttgggggctgaggcgggaggatcaattgagcctgggaggtcgaggctgtggtgagtggtgaccacaccacttcactccagccggggtgacagagcaggagaactgtcacctcctggggaccctgtttccctcgggtattcaaaaatctcccaaagggaggcaagcatgggctacgcagaagaactctcagtagggactgctgagtctcttcatatgagctgcagttcccacagtggcagtcacacaattggaaaaggtggtcccaaacttgtctctgaccttagcagatgacacaacttctactctagaaacccaacaaaccagtttaaatttaaattcatttgccatctcgacgtaacgagatgcgagataaggccaggcactgtggctcacacctgtaatcccagcactttgggaggccgatgcgggcgaatcacctgaggtcgggagttcgagaccagcctgaccagcatggagaaaccctgtgtctactaaaaatacaaaattaactgggcgtggtggcgcatgcctgtaatcccaactattcaggaggctgaggcaggagaatcacttgaacccgggaggcggaggttgaggtgagccgggatcgcgccattgcactccagcctgggcaacaagagcaaaactctgtctcaaaaaaaaaaaaataaataaataaaaataaaaaataaaaaagagatgcaggataacccccacaaaaatattcattagccagaattgtcatgaacataacccttgatttcctttggctagtcaagggggagtgtatgctttagtaaacacttctttttttttttcctcattgtcaagactcaacataaagcaaatactttttgatgcacctatatcaactctgcaagtcaagtagaacagtttctgatgaggttaaaagaaaaagttggccaggtgcagtggctcatgcctgtaatcctagcactttgggaggctgaggcaggaggatcaattgagctcaaaagtttgagaccagcctgggcaacatagcgagaatgtctcaaaaaaaaaaagaaaagaaaaagttacctggttctctacaggagaccaactaggctttgggacatatttccctggtctggtttggccgtctaggctcctgtcttcggagtctagtttgtttggttgaagtttttttgagacaggctctcactcagtcacccaagctggagtgcagtggtgtgatcacagttcactgcaccttcgacctccccagctcaggcaatcctcccacctcagcctcctgactagctgggacgacaggtgaaagccatcatgcctggctaattgtttgtatttttgtagagacggggatcttgccatgttgcccaggctggtctcaaactcctgggctgaaccgatcctcccgcctcagcatctgaaagtgctgggattacaggtgtgagccacagctcccagccttcagtgtctattataaagactaaacctcagcttgtttctgtgattgcctgtgttgcatttggccaatgtatcctgtccagagtcttttttttaaaaaggttttcaaagtccagtgtcgtggttcacgtctgtaatcccagctactagggaggctgaggtggaaggatcacttgagcctgggaggttgaggctgcagtaagctgtgatcactgcactccagcctgggcaacagagagagaccctgtctcaaaaaaagaaaaagttttggccgggcacagtggctcacacctgtaatcccagcactttgggaggccaaggaaggcggatcacccaaggtcaggagttcgaggccagcctcaccaacatggcgaaacccggtctctactaaaaagaaaaaaaaaattatccaggcatggtggcgggcatctataatgccagctactcaggaggctgaggcaggagaatcacttgagcccaggaggtgggggctgttgtgagccaagatctcgccactgcactccaacctgggcaacagagtgagactctgtctcaaaaaaaaaaaagtttttaagatagtatttatttgtagttagagctgagttcttctgttagtttttaaatgtcttcctggggagtagcactttctaagggttccaagttcatccgttggctgtcatagccatccagcaatccaaggctgggctttggtgtcctgtagggaagctaggtccctcctgggtcgtggatcctggccttgcaggggcctggccaggcatagaggagagccttgtgcgagtgcctcacattctgcattgtggggaccccagtccatgtggtgtaggctgcagcgctgggaggagccagaacttgcgacctcgagagaggcggtagcagtagccccggctgggcctataacatctggaccttttcttagggctgaggccgcacctccgccagggcggcgggaagcatcgcggatggtggccaggtgggccatgcagctccccgttgctgcagcagtgctgggagcttgggagactgaggcaacccagcagccataatggtgagtatgaagccgacgctctccagagcatcaaaaatgcagaagggagtggctgggcatggtggctcatgcctgtaatcccagcactttgggaggccaaggtgggtggatcacctgaggtcaggagttcaagaccagcctggccaacatggtgaaaccctgtctctactaaaaatataaaaattagccaggcatggtggtctgtacctgtatttccagctactcaggaggctgaggcaggaggatagcttgagcacagcagtttgaagctatattgcactattattacgtctgtaaatagccactgtacttcatcctgggcaacatagccagaccccatctttattttattttatttttttgagacagagttttgctcttgttgcccacgctggagtgcaatggcgcgatctcagttcactgcaaactccacctcccgggttcaagcaattctcctcccaagagaagcctcagcctcccaagtagctgggattacagtcatgtgccaccatgcccggctaatttttgtatttttagtagagacagggtttcaccatggtggtcaggctggttttgaactcctgacctcaggtgatccaccctccttggcctcccaaagtgctgggattacaggcgtgagccactgtgcccggccaagagctcatctttaaataaataaatatatggtttttgttgttgttgttttgtttattttgttttgtttgtttgtttgtttttgacagacagtctcgctctaccgcccaggctggagtgcagtggtatgatcacagttcactgcaatctctgcctcccaggttcaagcaattctcgtgcctcagcctcccgagtagctgagattacaggcatggaccaccatgcctggctaattttttgtatttttattagggatagggtttcactatgttgcccaggctggtctcaaacttctgggctcaagtgacccacttgcctcggcctcccaaactgttgggattacaggtgtgagccaccatggctggccaaaaaatgtcttttcttaaaacaactttattgaggtatacttgtattgagatataactaatgttgtacacttacaacaaaaactacacatatctagtgtatacaatctgtgagtttgacttatgtatatgctcatgatactatcaccacaatcaagataataatcatatccatcacctccagcgtttccttgtgtccctttgtagtggtttgttttagctttggtttttttgtgtgtggcataacccttaacatgagatctaccctcttaacaaattttaaagtgcacaatgccatattgtaagctataattactatgttgtacagcagatctctagaactgattcttcatgcataactgaaactttatacccattgagaaacaagtctccctttcctctccccggagaccctggcaaccaccattctattctctgcctctatgagtttgactactttagatacctcatattagtggaatcctgcagtatttgtctttttttgtgactagctcatttcacttagcataacatccatgttgttgcaaatggtaagatttctttttcttttttttaattttatggagacagagtctcactctgttgtctaggctggagtgcagtggcacaatctcggctcactgcaacctctgcctcccgggttcaagtgattttcatacctcagcctcccaagcagtagctggactacaggcatgagccaccacacccagctggttttttgtatttttagtggagacggggtttcaccatgttggccaggctggtctctaactcctgacctcaagtgatctgcctgcctcagcctcccaaagtgctgggattacaggtgtgaaccactgtacccggccataagatttccttctttttgtggttgaataatatcccactgtatgtatataccacatttttgatatcctttcatgtgtcaatggactttcaggttgtttccataccttggctatggtaaataatgctatgatgaacatggaagtgtggatagctctttgagattcctgtaaaatcaacatacaaaaattaattgtgtttctatacactaacaactatctgaaaaggaaattaagaaaacaatcacatttgcaatagcatcacaaataattaaatacttaggaagaaacttaaccaagtaaatgaaatatctgtacaccaaaaactagaaaacattagtgaaagaaagtaatgaagacacaaataaatggaaagacatcctgttctcatgaattggaagacttaatagtgttaaaatatccataccattcaaagaagtctacaaggctggcgcagtagctcacacttgtaatctcagcactttgggaggccgacgtgtgtggatcacttgaaaccaggagttagagaccagcctgggcaacatggtgaaaccccatctcaactaaaaatacaaaattagccaggcatattggtgtacacctgtaatcccagcactttgggacgctgaggaaggcagattacttgaggccaagagttgaagaccagcatgggcaacatggtgaaaccctgtctctactaaaaatacaaaaaagttgtcgggtgtggcggcactcacctgtagttccagctactcgggaggctgaggtgggaggattgtttgggcctgggaaatgaaggttgcagggctgcagtgagccgagattgtgccactgccctccagtctgggcaacagagcaacattctgtctcaaaaacaacagcaacaacaacaaagtaatctgcagcctcaatcctagacccatcaaaatcccagtgacattttttacagcaatagagaaaacaattctaaaattcatatgtagccacaaaagacccagaatagccaaagcaatcttgagaaaaaagaacaaagctgtgaggtcagagccaccacagagaataggtctagtggagctttggaggtgggccccccccactccccaagaacccagaactgtagagctaccagcaagcaacagcagcttgggtgcctgcaacccctgagagattgctgtgtgggctgagcccagcaagcttgtgggggcggggctacctgaagccttgggggcccaatccctaccccagtgtgcccaaaggtggtgcataccgtcaaagataattgtggaggtttaagacaatgttgtttgccctgtgggcttttggatttgctgggaactgctattccttttttctttcctgttgctccctttaggaatgggaacattcatcttctgcctgtcccactgttgtattttggaagtagataacttgtgtttgtttttgagatggagtctcactctgtcactcaggctggagtgcaatggtgcaatcgcggctcactgcaacctccacttcctgggttcaagcgattcttgtgcctcaccctcctgagtagctgggactacaggtgcgtgccaccactcctggctaatttttgaatttttagtagagacggggtttcaccatgttggccaggctggttttgaactcctgacctcaagcgatccacccaccttggcctcccaaagtgctggggttgcaggcgtgagccaccgcatccagccgagataatttgttttgatttcacaggttcacagctggaggaatttgctttagaatgaactgtgcttacagtatcacccatatctggtttagacgagactctgggctttgaacttttgagttggtactggaacaaattaagactatgggtctattgagatggaatgaatgtattttacatgtgagaagggtatgaatttggtggaccagaggcagaaggctgtggtttgaatgtgtccccaaaaagcatgtgttaaaaacttaattcccaatgcaacagtgttgggaggtgaggcctaatgagaggtgattaggccatagggcagagtgaaggaattaatgctattatcacaagagtgggttcactataaaagggggagtttaaccccctgtattagtctgttttcatgctgttgataaggacatacccgagactgggcaatttacaaaagaaagaggttgaatggactcacagttacacgtggctgaggaggcctcacaatcatggtggaagatgaagggcacatctcacatggcggcagacaagagaggagagcttgtgcaggaaaactcccctttataaaaccatcagatctcatgagacttattcactatcgtgagaacagcatgggaaagacctgcccccatgattcaattacctcccaccaggtctctcccacaacaggtgggaattcaagataagatttgggtggcgacacagccaaactatatcattctgcccctggcccctccaaaatttcatgtcttcacatttcaaaaccaatcataccttcccaacagtcccccaaagtcttaactcattccagcattaactcagaagtccacagtccaaagtctgatctgagacaaggcaagtcccttccgcctatgagcctgtaaaatcaaaagcaagttagttacttcctagatatgatgggggtacaggcattggctaaatacaactgttccaagtgggagacattggccaaaacaagggggctacagaccccatggaagtcagaaatctagtggggcagtcaaatattaaagctccaaaatgatcttctttgactctatgtctcacatccaggtcacactgatgcaagaggtaggctcccatggtcttgggcagttccacccctgtggctttgcagggtacagactccttcccagcagctttcatgggcttgtgttgagtgtctgtggcttttccaggctcatggtgcaagctgttggtggatcgactattctggggtctggaggatagtggccctcttctcacagctccactaggcagtgctccagtggggactctgtgtgggggctccgaccccacatttcccttctgcactgccctagcagaggttctccatgaggactttgcccctgcagcaaacttctgcctggacagccaggcatttccatacatcctctgaaagctaggcagaggttcccaaacctcagttcttgttttctgtgcacctgcaggaccaacaccacatggaagctgccaaggcttggggtttgcaccctttgaagcaacggcctgagctgtaccttggctccttttagccacggctggaaaggctgggagtccctaggctgcacacaggagggggtgccctggacccagcccaggaaaccatttttcccttttaggcatccaggcctgtgatgggcgggcctgccccgaacgtctctgacatgccctggagacattttccccattgtcttggtgattaacattcggttcctcgttacttatgcaaatttctgaagtggcttgaatttctccccagaaaatgggggtttcttttctatcacatattcaggctgcaaatttttcaaacttttatgctctgtttgtttcctcttgaacacttagctgcttagaaatttcttccgccaggtatcctaaataatctctctcaagttcaaagttccacagatctccaaggcaggggcaaaaagccaccagtctctgctaaagcatacctttgctccagttcccaacaggttcctcatctccatctgaggccatatcagcctggaatttatttttcatatcactaccagcattttggtcaaagccattcaacaaatgtctaggaagttccaaacttccccacatcttcctgtctcctttagagccctccaaactgttccaacctctgcctgttacccagttccaaagttgcttccacatttttgggtatccttatagcagcacccaactcctggtaccaatttactgtattagcccctttataaaaccattagtctaagggaggagaccacccctcatattgtcttatgctcaatttctgcctccaaagaaagaagaagtaaaaactaaaaggcagaaatgaaatccataggctgccacaccctgggcctggttaaagattgacccctgacctaaccagttatgttatctatagattccagacattgtatggaaaagcattgtgaaaatccctgtcctattctgtcccgttccgattaccagtgcatgcagcccccagtcacgtaccccctgcttgctcaattgatcatgactctctcacgtggacccccttagagttgtaagcccttaaaagggatgggaattgctcactcggggagctcagtttttggagatgtgagtcttgctgaagctcccagctgaataaagcccttccttctttaactcggtgtctgagggattttgtctgaggcttgtcctgctacattacttggttccctgaccagttagaaaggtgattaatggatggtggaggcagccccttaggcagcttaggcctgccctgtggagcatccctgcaggggactccagccagcttgagtgacgcggatcctgagagtgccccggggtaggcaattaccccagtggaacgcctcaccagagcagcatgtggcaggcccctgtggaagatcaactcagtggctgaacaccgggaaggaactggcacttggagtctggacatctgaaacttggtaagactggtctttggaacttgcccactccatttcaatggaagcgtggcctgatcacccacgatgtgcctgtaccggcactttggtttttgtttttgacttgacttgggttgcttgatactttggttttggttttgacctggcttagatttctggatactctgattttggttttgattctggtttggtgtaaactgtaaaagtgtgtgtgtgccctttttacccgttctttgttttgtggtgtgtgtgtggtgtgagagtggtgttttgtcttgaggaagcatgggtcgggcacaaggtaagcccaccccactaggaactatgttgaaaattttcaagaaaggatttacgggagattacagtgttactatgacaccaggaaaacttagaactttgtgtgaaatagactggccagcattagaggtgggttggccatcagaaggaagcttggacaggtcccttgttttaaaggtatggcacaaggtaacctgtaagccagggaacccagaccagttcccgtagctagacacttggttacaggtggttttagacccccccacacacacagtggttgagagaacagcagcataagcggctggcagaggcaaggaaagaccagcagagggagagagaggaaagagacagagaggaaagaggcaaagagagagaggaagagacagagagacaaagagggagtcgaggagaaaaagagaggaagagacagaggcaaaaggaaagtcaaaaagagagacagaaagtcaaaaaaagaaagagagaaatatacaagtagttaaaaaaaaaaaaaacagcgtaccctatctattcctttaaaagcccgggtaaatttaaaacctataattgataattgaaggtcttctccgtgaccctacaacactccaatacaaccttgttgtaagtgtaaacaagggcgtagcctgaaagcattgaggccactgactacctgtagccttcctatcaaaaatccttaacccagtaacctgtggatggcccaaatgcattcaatctgtagtggcaactgctttgctaacagaataaagtagaaaaataacttttagaggaaatctcattatgagcacacctcactagttcagaagtatcctaagcgggggaaaaaaaaagatgatttaacattaaccactgaaaattcccttaacccagcaggtttcctaacaggggatctaaatcttaattaccatacaaaggtctgatcagacctaggaggaactcccttcaggacaggatgatagatgcttcctcccaggtaattgaagaaaaaaaagccatctataccaattctaagttaatttggactaaacaaggtcttattaatagcaaaggataattgaaatcccaaacttacaagattttcaacaaaagtaaagtttgctaaaagttaacaatgtaacatgtattataataacttctaatcttgtggccttagacaatctagcccacagacataaaggaagttcactttggaaaagaatggttatcttagaagaaaaaaaaaaaggggggaaaagatgggggcagagtttatgtaaaaagaatattatatggtaaattcttgtcctgaaataaattaactggttgtttaaagaaagaaatgtttgtaataagtctgaaagttgaggcaggtcaaagaattgtctgtgaaagtcatgaaagagaaaaaatatatattataaaaaaagaatttatgcaagaaatgttgtataatttaaaagtaactaagcctcctgaatgtaaaactattgaaaaaatagtttatgtgcaaggtgtataaggaaagtaaaatatacctttggtaaaaggattataaggtggcataagaatgtaaatttttacctacattaaaaggttaaaacaaatttgttttgaaggtttaagcaagttttaaaatgttaattgtaaaaaaaattctgcgtgtaaacatattagctaaagttaaaggggtatcatccagtttttctgtgaagtgaacattaaaataaaaacacaacgtgtttctcttaaagcactaacctgctctttaacacagattataaaaggttaaaaagagtctataaaaatcttaccttatggtctgacattaaaaactgaataaatatgtctgcaaagttttattaaaactaagtttaacattggccgggcgcagtggctcacgcctgtagtcccagcactttgggaggccgaggcgggcagatcccaaggtcaggagatcgagaccatcctggctaacacggtgaaaccccgtctctactaaaaatacaaaaaattagccgggcgtggtggcaggcgcctgtagtcccagctactcgggaggctgaggcaggagggaggcagagcttgcagtgagccgagatggagccaccacactccagcctgggtgacagagtgagactccatctcaaaaaaaaaaaaaaaactaagtttaacattaataacacactaatataaaggtgaaatttagcttatctggtataaaaatcatacaggaagcattatcaaatataaaatggtgtttgacttctttggtccaaaaactaataaaaataggtgctaaaggaaatttctcagtagaaagtcaccaaggactataatgtccactgctgatgtccccacatttaaaacaaaaggtcagtttcttaaaaattatatacttggttaatcctccacttccctttccctcaaaactaaaagtcttttagcacatgtaccacccctagaatttccagtaaaccagcaccagcaccagcctgaagatcacgttctcatcaaaggatgaaaaaaaaggaaactcgagccagcctaggaaggaccctatcttgtgctgctaaccaccgagactgctgttcgtacagcgaaaaaaggatggactcatcacacctgagtcaagaaagcgccaccccctccagaatcatgggccatagtcccaggggaaaaccctaccaaactaaagctaagaaaaatttaactctttcatctattctattactctttcttctttcctcgctctattgctgaccatctagttattaacataaccaagtcaattttacctcagactattgcatttaatgcttgtcttgttataccctgtggggacctgccaagtcaaagacagttctgtacttgagaaaaatacatctgtccctcctgactctcctcagactgggcattggtaaattaggaccatttaatcaggggaaatttcaataaagactccagtgtcaaccaggagtcttgctccccaatgtagagcttttatgctgtacttggtccaacattctgtggaccactaaagtgcaaggatggactgccccaactggtttttgtaatttcctaaaatcatacattcattttactagaggatcatagaagttaaagacttaaaacaaactttggcaattaagacaggataccaagatgcaaatgcctggttggaatggatcaaatattccgtctgcaccttaaacaaaagcaattcttatgcttgtgcatatggcaggccagagtcccagattgtcccctttccactaaggtggtcctccagtggaccaggcatgcgctgcatggtagctcttttccaggattctacagcctggagtgataagtcgtgccaagctctctctgctatatcccaaagtacggcaccctgtgggtcagcccccaagggccatccagcttccgtctcccaacactaacttcacttcttgtctctcacgacagggaggaaacttagcattccttggagacctgaagggatgcagtgagcttaataattttcaagagcttatcaatcagtcagcgcttgttcatccctgagtggatgtgtggtggtattggggtggacctttattgggcactctgccgaataactggagtggcacttgtactttagtccaattggctatccctttcaccctggcatttcatcaaccagagggaggaaaaataagacattgtaaagcgagagaagccccttataggtctttcgactctcatgtctatttagacgcaattggagtcccatggggaataccagatcaatttaaagcttgaaatcaaatagctgcaggatttgagtcaatattttggtcggtgacagttaataaaaatttagattggataaactacatctattacaaccaacagcaatgagcttttcatgagttaaaagaaaaactcatgtcggccccagccctggggctacctgacctgacaaaaccctttacactctatgtgtcagaaagagaaaaaatggcagttttggagttttaacccagactgtggggccctctctcaaaacaactagacggggtttccaaaggctggcccccatgtctaagggccctggcagcaatggccctgttagcacaagaagcagataaactaacccttgggcaaaacctgaatataaaggccccccatgctgtggtaactttgatgaataccaaaggacatcactggataacaaatgctagattaaccaagtaccaaagcttgctatgtgaaaatccccacataaccactgaagtttgcaacaccctaaacccagctaccttgctcccagtatcagagagcccagttgaacacaactgtgtagaggtattggactcagtttattctagtgggcccaacctttgagaccatccttgaacatcagtagactgtgagcggtatgtggacgggagcagcttcgccaacccctgcaaagtaactctgaagaagtcgacaagccctgctccagtcacacccggaagctgactggtccacgcacggctgaagcatgagaaaactcatcgcgggactcattttccttaacatttggacttgtacagtaaggacttcaactgaccttccttggactgaggactgttcctagtgtatacatcaagtcactgaggtaggacaaaaggttgctatggtcctattattttatggttattataagtgtactagaactctaaaaagaacttgcttgtataatgttattctatacaaggtacatagcccaggaaatgaccaacctaatgtgtgttatgacccatctgagcctcccatgaccacagtttttgaaataagattaagaactgaggactgatgggggctcataaacaatacgagtaaagtgttagccaaaacagaagaaaaaggggtgcccaaacaagtcaccttgaaatctgatgcctgtgctgtcattaatagtaataagttaggaatatgatgtggttcccttaattaagaaagaggctatatggcagaacgtaagtacacttgtcatgaattaagactgtgtggaaataaatgtggatagtggtcttgtgtcatttaggctacttggataaaaaataaaaaaaatcctgtccatcttcagaaagggaaaagtggcccttcctgtaccagtggtcagtgtaaccccttagaactggtaataaccaaatcccttgatccttgctggaaaaaaggggagcatgtaaccttaggaactgatggggctggactggatcctcgagtaaatattgtggtttgagtagaagtttataaacactctcctgagccagtatttcaaaccttctatgatgaactgaatgtgccagtaccagaaattccaggaaaaacaagaaatttgttttttcaattagccgagcatgtagcccagtctctcaatgtcacttcatgttatgtatgtggaggaacggtaatgggagaccaatggccatgggaagcccaaaaattagtacctacagacccagttcctgatgaattcctggctcaaaaaaattaccctgataatttctgggtcctaaaagcctcaatcattagataatactatatagcaagagtggggaaggacttcacccttcctgtgggaagactcagctgccttgggcaaaaactgtataatagtactacaaaaacagccacctagtggagttcaaaccacactaagaaaaatccatttagtaaattcccaaagttgcaaaacgtgtggacccacccagagtcccaccgggactggacagcccccactagattatactggatatgtgggcatagaccttatgtcaaattacccaaccagtgggcaggtagttgtattattggcactattaaaccatctttcttcctactgcccataaagacaggcgaactcctgggcttccctgtctatgcttcccacgcaaagagaagcatagctattggaaattggaaagataatgaatggccccctgagagaatcatacaatattatgagcctgctacttgggcacaagacggcttgtggggataccagatccccatttacatgctcaaccgaatcatatggttacaagctgtcttagaaataatcactaataagaccagcagagccttgactattctggcccggcaagaaacccaaatgagaaatgctatttatcaaaatagattggttctcgactacttgctagcagctgaaggaggggtctgtgggaaatttaaccttactaattgctgtctacacatagatgatcaagggcgagtagttgaagacatagttagaaatatgacaaaattggcacatgtgcccgtgcaaatgtggcatggatttgatcctggggccatgtttggaaaatggttcccagcactggaaagatttaaaactcttataatgggagttataatagtaatagaaacctgcttactgctcccttgtttactatctgtacttcttcaaacgataaggagcttcatcgctaccttagttcaccaaaatgcttcagcacaggtatgctatatgaatcactatcgatctatcttgcaagaaggcatgggtagtgagaatgaaagtgagaactcccactattgagtgagattctcaaagcggggaaataagggaggagactacccctcattttgtcttattcccaatttctgcctccaaagaaagaagaagtaaaaactaaaaggcagaaatgaaatccacaggcagacaacccagcgctgcaccctgggcctggttaaagatcgaccccaacctaacgggttatgttatctataaattccagacattgtatggaaaagcactgtgaaaatccctgtcctgttctgttccattctgattactggtgcatgcagcccccagtcacctacccctgcttgctcaattgatcatgaccctctcatgtggacccccttagagttgtaagcccctaaaagggacaggaattgctcactcagggagctcggtctttggagacatgagtcttgccgaagctcccggctgaataaagcccttccttctttaactcggtgcctgagggattttgtctgtggcttgtcctgctccaagtccctttataaaaccattagatctcatgggacttattcactatcatgagaacagcactggaaacacctgccctcatgattcaattacctcccaccaggtccctcccaaaacatgtgggaattcaagatgagatttgagtggggacatggccaaatcatatcacccccattctctctctctctctgtcacccttgctttgcccttctgccatggaatgatgcagcaagctttgcctagttgctggtcccttgatcttggactttccagcctccagaaccttgagccaatgaaattctgttcattataaactacccagtctggccaggtgtggtggttcacgcctgtaatcccagaactttgggaagccaaggcaggcgggtcacgaggtcaggagttcaagaccagcctggtcaacatggcaaaacctcgtctctactaaaaatacaaaaattagccaggcatggtggcatgtgcctgtaatcccagctactctggaggctgaggcaagagaattgcttgaacccagaaggcagaggttgcagtgagccaagattgcgccactgcactccagcccatgcaacagagcaagactctgtctcaaaaaaaaaaaaaaaaaaattacccagtctgtagtattctgttacagcagcacaaaacagactaagacatatggtcttagtctgatctttgagtagattgtcaatcagtagattgactgatctttgagtagagtgtcaagaatatacaatggaaaaatgatagtatcttcaacaaacattgttggaaaaaccagatatccacatgcagaagaatgaaattggacccctatcttacaccatacacaaaaatcaactcaaattagctgggcgtggtgactcacgcctgtaatcccagcactttgggaggctgaggcgggcagattgcctcaggtcaagagttagagacagtttggccaacatgctgaaactccatctctactaaaaattcaaaaattagccaggcatggtggtgcacgcctgtagtcccaggtactcgggaggctgaggcaggaggattgcttgaacctgggaggcaaaggttgcagtgagctgagatcgtgccactgcactccagcctggggaacagagcaagactccgtctcaaaaaaatcaactcaaaatggattaaagacttaaatgtaataccggaaactgtaaaactcctagaagaaaacacaggaggaaatcttcttgacattggtgttggcagtgatttattggatatgacacaaaaagcacaggcaacaaaagctaaaatagacaagtgggactacatcaatccgaaatattctgcacagcaaaggaaacaacacagagtgaaaagggatcatacagaatggaacaaaagatttgcaaaccatttctcgcttaaggggttgatatccaaagtacagaagaaactccaacagctcaatagcaaataacaaaaagaacaacaatttttttttttttgaaacagagtcttgctctgtttcccaggctggagtgaagtggcacaatctcggctcactgcaacctctgcctcctgggttcaagcgattctccttcctcagccccgcaagtaactgggattacaggcaccttccaccatacctggctaattttttgtatttttagtagagatggagtttcgacatgttggccaagctggtctcaaactcctgacctcaagtgatctgcccgcctcggcctcccaaagtgctgggattacaggtgtgaaccaccgtgcctgaccaaaaaaataataatttgattaaaaagtggacaaaagacttctccaaagaagacatacaaatgccaccaggggcagggtgcggtggctcacatctgtaatcctatcactttgagaggccaaggcaggaagattgcatgaggctaggagttcgagaccagcctgggcaacatggtgaaaccccgtctctacaaacacatacaaaaattagccaggtgtggtggtgcatgcctgtagtcccagctacttggaagggtgaggcgggaggatcactcaatcccaggaagtcgaggttgctgagctgtgattaaacaactgcactccagtgggtgacagagcgacactccgtctcaaaacaaaacaaaacaaacatcattttcagaccagcttgggagccagccctactctctctcaaaagcctcattgtgtgagtaataaatttttcataccttcttggtgtatgcgtggcatcagcaggcttgacatttgaaccaaatttgctgtgtgtgtgtattcatggatccacctcacctctgcagggtgatacagtaatgaccttgacaaaaggggtactgacaaaaagaaatgcagtccctgacatccaagaactggcctggttcatcacctaagccttggtgttgtgagcagctgacctgacactcccatcggtgtctcctgttgatcatgaacaattccacaaaatattaacatcagatgaagctgctctgcggtcatggtagatcaagacaaaaacaagaccagtctggaatcaagtctgagacacagaaaaaaacatggacgttgtccaaaccacaaaatggccaaacatccgtccatcctggctgatgtgagtggttcctgcttccttatcagttatagctttcatccacttcattccttttgccttgtagatataaatcaagatattacatcctagaattactcctactttctgacaggaggcaatccagagcaaagtcctgcttctttaaccctctctgaaatcacctaacacaaactccaacccagtaataccttttcttttcttgtcttgtcttttcttcttcttctttttttttttcccgagacggagtcttgctctgttgcctagaactggagtgcaatggtgtgatctcagctcactgcaacctccgcctcccaggttcaaacaattctcctgcctcagcctcctgagtagctgggattacaggtgcaccccaccatgcctggctaatttttttgtatttttagtagagacagggtttcaccatgttggccaggctggtctcaaactcctgacctcgtgatccgcctgcactggcctcccaaagtgctaggattacaggcatagccactgtgcccagcctctttttttctttttctttttttttttttttttgttgttgttttttttgagacgatcacagctcactgcagcctcgaactcttggggtcaagcgaccctccctcctcagtctcctgaatagctgagtctacaggtgcatgccaccatgcctatctacttttcaaattttttttagagatgagggtctcactaggttgcccaggttggtctcgaactcctgggctcaagtgaatctcccacctcagccttccaaaacgctgtgattacaggtgtgagccaccgtgtccggctcccttttctaacacccttttaatgagatgctccatggtttcccacgatgtggatgcttcatcattgcaatgagttaataaatccaacttccgggccaggcacagtggctcacgcctgtaatcccagcacttggggaggccaaggtgggtggatcacctgaggtcaggagttcgagaccagactggccaacatggcaaaacccccgtctctactaaaaatacaaaaaattagccaggtgtggtggtgcatgcttgtaatcccagctacttgggaggctgaggcaggagaattgcttgaacctgggaggtggcggtcacagtgagccaagattgcacagctgcactccagcctaggcaacaagagcgatactccacctcaaaacaaaacaaaaaaaaaattagccgggcatggtggcccatgcctgtagtcccagctactcaggaggctgaggcaggagaatcgcttaaacctgggaggtggaggttgcagtgagccaagatcgcagcactgcactccagcctgggcgacagagcgagactccgtctcaaaaaaaaaaaaaaaaaaatctaattttggtaaactaccactatgctcctggtggtctttggctggagggcattggtgttattcacttagaaaatccaagagaatcataaaaaaaaaaaaaaaaactcttagacttaataagagaagtcagcaaggtgaccaaaaccaaaaatgaatacaaaatacaaagatggggccgggcgcggtggctaatgcctgtaatcccagcactttgggaggccgaggcgggtggatcacgaggtcaggagattgagaacatcctggctaacatggtgaaaccccgtctctactaaaaaagtacaaaaaattagccgggcgtggtggtcggcgcctgtagtcccagctactcgggaggctgaggcaggagaatggtgtgaacccgggaggcggaggttgcagtgagccgagatagcaccactgcacttcagcctgggcgacagagcgagactccgtctcaaaaaaaaaaaaaaaaaaaacaagaaaaaaaaaaaacaaagatgggtatagccttccttgacagacacctgaaatcagaaaatgtaagagggcagggtaccgttgatcacagtaacaaaatttatcaacctcttgtaagcaagaaaagtgtgagctcggccaggcatggtggctcatgcctgtaatcccagcactttgggaggctgaggtgggcagattatgaggtcaggagatcgagaccatcctggccaacatggtgaaacctcgttcatactaaaatacaaaaaattagctgggtgtggtggtgcacgcctgtagtcccagctacttgggaggctgcagcaggggaatcgcttgaacctgggaggcggagattgcagtgagccgagatcgcgccactgcactccagcctggtgacacagcgagactccgtttcaaaaaaaaaaagaaaagaaaatatgagctctatacattttgacagaagaaaaaaatgaccagaataaatggaaaggtatatccgtatttcaggcaaaaagaatcaacactggaggccgagtgcgcctgtagtctcagctacctgggaggctaaggcagggggattgcttgagcccaggaggtcgaggtttcagtgagctaagatggcaccactgcactccagcctgggtgacagtgagagtctatctcaaaataaataaataaaaataaaagaaagaaagaaacaaaaaagccatgtcccgtagtacctcaggcacctccctgtgacttgaacagcatgatttcatgttgccaggttttttgttttttggcttttttttttcttgaggcagacttttgctcttgttgcccaggctggagtgcaatggtgtgatctcggctcactgtgacctccacctccaggattcaagagattctcctgcctcagcctcccaggtagctgggattgcagatgtgcaccatcatacccggctaattttgtacttttttttagtagagatggggtttcaccatgttggtcaggctggtcttgaacttctgatctcaagtgatccacccacctcggcctcccaaagtgctgggattacaggtatgagccaccatgcctggccatgaagccaggtttttgaactttgtataaagggaatcatatagtattatccttctgtgtcctgcagcttcttttgcccaacattgtttgtgaggtccatccctgttatgcacatggaattatcctttcttcagtttcattgtaagtcagaactgtgaagggtttgagtttaccctacttgcaagctaaaaagttagcctgccaaattttgcacagacacacatacatgcacatgtgcatacacacagatatataaaacacaagaccccagcctgggcaacatagctagactctgttgctacaaacaaattaaaaaaaattaggggcttgatggcacatgcttgtagtctcagctacttgggaggctgaggtgggaggattgcttgagtcctggaggtcgaggctgcagtcagctatgaacacgacactgcactccagcctgggtgacagagtgaaattttgtctcaaaacacacacacacacacacacacacacacacacacacacacgatcatgaatcagaaaaatggatcattgattaccacaaaatcagcagccagagctataccttgcatcaattcctcatgccccagctcacacgaagccagatatttcctgtgcgttcagtgggttgcatcatgcgggaagaaactaaaattaggagactaagctgttgtgaacttgctgacacacctgcctgtcctcccctccatagccagagattattcattaccctggaatgtcagcaatctcctggttgtggggaggggtggggcatttctatgtttcttacgctgaactgtctctaaatctctccagagggatgcactatctcaatatccaaggctgctgttcaaacattgttcagaaggcctagcccatgcaggaacatgagtgatctgtgcagatctgcctcccaacacattgctatatagtatttccttgcgtgaatataccatcatttttgtatccattctttggctgatgtgcatttgggtagtttttagtttggggctattatgaaaaaagttgctataaacattattttatgtctttggttaacatttatacacattctgttctcgcttcatttcattcgtttgatcttccatcactgataccatttcttccagttgattgaatcggctactgaggcttgtgcattcgtcacatagttctcgtgccttggttttcagctccaccaggtcctttaaggacttctctgcattggttattctagctagccattcgtctaattttttttcaaggtttttaacttctttgccatgggttcgaacttcctcctttagctcggagtagtttgatcgtctgaagccttcttctctcaactcatcaaagtcattctccgtccagctttgttccattgctggtgaggagctgtgttcctctggaggaggagaggcactctgatttttagagtttccagtttttctactctgttttttccccatctttgtggttttatctacctttggtctttgatgatggtgacgtacagatgggtttttggtgtggatggcctttctgtttgttagttttccttctaacagtcaggaccctcagctgcaggtctgttggagtttgctggaggtccactccagaccctgtttgcctgggtatcagcagcggagggtgcagaacagcggatattggtgaacagcaaatgtcgctgcctgatcgttcctctggaagttttgtctcagaggagtaacggcccgtgtgaggtgtcagtctgagaaaaaagaataaaaagaaacgaacaaagcctccaagaaatatgggactatgtgaaaagaccaaatctacgtctgattggtgtacctgaaagtgacggggagaatggaaccgagttggaaaacactctgcaggatattatacaggagaacttcctcaatctagcaaggcaggccaacattcaaattcaggaaatacagagaacaccacaaagatactcctcgagaagagcaactccaagacacataattgtcagattcaccaaagttgaaatgaaggaaaaaatgttaagggcagccagagagaaaggtcggcttacccacaaagggaagcccatcagactaacagctgatctctcggcggaaaccctacaagccagaagagtgggggggccaatattcaacattcttaaagaaaagaattttctgccgggtgcggtggctcacacctgtaatcccagcactttgggaggccaaggcgggagaatcatgaggtctggagtttgagaccagcttggccaacatgttgaaaccctgtctctactaaaaatacaaaaaaaaaaattacccgggcgtagtggcagacacctgtaatcccagctactcaggaggctgaggcaggagaatcgcttgaaaccagaaggcggaggttgcagtgagcccagatcacaccactgcactccagcctgggcaataagagcgaaactctgtctcaaaaaaaaaaaagaaaagaaaaagaaaagaattttcaacccagaatttcatatccagccaaactaagcttcataagtgaaggagaaataaaatactttacagacaagcaaatgctgagagattttgtcatcaccaggcctgccctaaaagagctcctgaaggaagcactaaacatggaaaggaacaaccggtaccagccactgcaaaaacatgccaaattttaaagaccattgaagctaggaagaaactgcatcaactaacgagcaaaataaccagctaacatcataatcacaggatcaaattcacacataactattaaccttaaatgtaaatggactaaatgctccaattaaaagacacagactggcaaattggataaagagtcaagacccatcagtgtgctatattcaggagacccatctcacgtgcagagacacacataggctcaaaataaagggatggaggaagatctaccaagcaaatggaaaacaaaaaaaggcaggggttgcaatcctagtctctcataaaacagactttaaaccaacaaagatcaaaagagacaaagaaggccattacataatggtaaagggatcaattcaacaagaacagctaactatcctaaacatatatgcacccaatacaggagcacccagattcataaagcaagtccttagtgacctacaaagagacttagactcccacacaataataatgggagactttaacaccccaccgtcaacattagatagatcaacgagacagaaagttaacaaggatatccaggaactgaactcagctctgcactaagtggatctaatagacatttacagaactctccaccccaaatcaacagaatatatgttcttctcagcaccacaccgcacttattccgaaactgaccacatagttggaagtaaagcacttctcagcaaatgtaaaagaatggaaattatgacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatattctttgaaaccaacgagaacaaagacacaacataccagaatctctgggacacattcaaagcagtgtgtagagggaaatttacagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaacatcaatgaatccaggagcttgttttttgaaaagatcaacaaaattgatagaccgctagcaagactaataaagaagaaaagagagaaggatcaaatagaagcaataaaaaatgataaaggggatatcaccaccgatcccacagaaatacaaactaccatcagagaatactataaacacctctacgcaaataaactagaaaatctagaggaaatggataaattcctcgacacatataccctcccaagactaaaccaggaagaagttgaatctctgaatagaccaataataggctctgaaattgaggcaataattaatagcttaccaaccaaaaaaagtccaggaccagatggattcacagccaaattctaccagaggtacaaggaagagctggtaccattccttctgaaactattccaatcaatagaaaaagagggaatcctccctaactcattttatcaggccagcatcatcctgataccaaagcctggcagagacacaacaaaaaaagagaattttagaccaatatccctgatgaacatcgatgcaaaaatcctcaataaaatactggcaaaccgaatccagtagcacatcaaaaagcttatccaccatgatcaagagggcttcatccctgggatgcaaggctggttcaacatacacaaatcaataaacataatccagcacataaacagaaccaacgacaaaaaccatatgattatctcaatagacgcagaaaaggcctttgacaaaattcaacaactaaaactctcaataaattaggtattgatgggacgtatctcaaaataataagagctatctatgacaaacccacagccaatatcatactgaatggacaaaaactggaagcattccctttgaaaaccggcacaagacagggatgccctctctcaccactcctattcaacatagtgttggaagttctggccagggcaatcaggcaggagaaggaaataaagggtattcaattaagaaaagaggaagtcgaattgtccctgtttgcagatgacatgatttatatatctagaaaaccccatcatctcagcccaaaatctccttaagctgataggcaacttcagcaaagtctcaggatacaaaatcaatgtgcaaaaatccaagcattcttaaacaccaataacagacaaacagccaaatcatgagtgaactcccattcacaattgcttcaaagagaataaaatacctaggaatccaatttacaagggacgtgaaggacctcttcaaggagaactacaaaccactgctcaatgaaacaaaagaggatacaaacaaatggaagaacattccatgctcatgggtaggaagaatcaatatcgtgaaaatggccatactgctcaaggtaatttatagattcaatgccatccccatcaagctaccaatgactttcttcacagaattggaaaaaacttctttaaagttcatatggaaccaaaaaagagcccgcatggccaagtcaatcctaagacaaaagaacaaagctggaggcatcacgctacctgacttcaaactataccataaggctacagtaaccaaaacagcatggtactggtaccaaaacagagatacagaccaatggaacagaacagagccctcagaaataatgccgcatatctacaaccatctgatctttcacaaacctgagaaaaacaagcaatggggaaatgattccctatttaataaatggtgctgggaaaactgactagccatatgtagaaagctgaaactggatcccttccttataccttatacaaaaattaattcaagatggattaaagacttaaatgttagacctaaaaccataaaaaccctagaagaaaacctaggcaataccattcaggacataggcatgggcaaggacttcatgtctaaaacaccaaaagtaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatacccagaatctacaatgaactctaacaaatttacaagaaaaaaacaaaaaaccccatcacaaaaagtgggcaaaggatatgaacacacacttctcaaaagaagacatttatgtagccaaaagacacatgaaaaaatgctcatcatcactggccatcagagaaatgcaaatcaaaaccacaatgaaataccatctcacaccagtcagaatggtgatcattaaaaagtcaggaaacaacaggtgctggagaggatgtggagaaataggaacacttttacactgttggtgggactgtaaactagttcaacccttgtggaagtcagtgtggcgcttcctcagggatctagaactagaaataccatttgacccagccatcccattactgggtatatacccaaaggattataaatcatgttgctataaagacacatgcacatgtatgtttattgtgacactattcacaatagcaaagaattggaaccaacccaaatgtccaaaaatgatagactggattaagaaaatgtggcacatatacaccatagaatactatgcagccataaaaaatgatgagttcatgtcctttgtagggacatggatgaagctggaaaccatcattctcagcaaactattgcaaggacaaaaaaccaaacaccacatgttctcactcataggtgggaattgaacagtgagaacacatggacacaggaaggggaacatcacacaccagggactgttgtgggatggggggcgggggaggaatagcctttggagatatacctaatgttaaatgacgagttactgggtgcagcacaccaacatggcacatgtatacatatgtaactaacctgcacgttgtgcacatgtaccctaaaacttaaagtataataataaaaaaaaggataaaacaaaacaaaacaaaaaaacatttatacacattctgtttagtatatacccagaagtggcatcactgagtgatgggtgtgcacatatacagctctagtagaaactgccggctgggcatggagacttatgcctgtaatcccagcactttgggaggcgaaggcgggtggatcacctgaggtcaggagttcgagaccagcctggccaacatggtaaaatcccatctgtactaaaaatacaaacattagctgggcgttgtggcgagcgcctgtaattccagctacttgggagcctgaggcaggagaatcacttgaacccaggagacagaggtttcagtgagccaagatcttgccactgcactccagcctgggtgacaagagtgaaactctgtctcaaaaaaaaaaaaaagaaagaaagaaaaaaggaactataaaacggttttccaaaataattgttgtatccattatgctcccatcagctgtgaatgagacattctgtctctggaaatgcttaccaacagttggtattatcagattttaaattttttctctatctggggctgggtagcggtggctcacacctataatcccagcacttagggaggcgaaggcaggcagatcacctgaggtcaggagttcgagaccagcctggccaacatagtgaaacctcgtctctacttaaaaagtacaaaaattagccggacatggtggcacatgcctgtagtcccaggtactcaggaggctgaggcaggagaattgcttgaaccccggaggcagagattgcagtgagccgagatagtgccactgcactccagcctgggcaacagagcaagactccatctcaaaaaaaaaaatctttttgcctatctgatagacaggaaataacattttgttcctttaatatacagctctctgatttagtgtgagcatatttctatatatttattggccatttgggtttcctcttatgcaaaatgtttgttcataacctttgcatactttttgattgggcgtcttgtctttcccttaaaattttttaggagttctttttatatgaggggtcatctaaaagtacacggaaaatgcatttggtgaaaaaaactatatgcatggatttcaaatgttttatagttttttgttgtttttctgttttgcttttttccttcctatttttgttttgcttttatttatttatttttgttttttcttttttgaatttcaatttttttttacaccaaaataaatctgtactaacttgttataacatgtctgaacaggatctggtttgaggggttaagaaggataagacatcaatttgaaaagagcctctaccagagccacatgaattctgctaatactgaagcaagaacaaaatcaaatttatggtgatggttgggtggaagaatggtgaaaaatcattgatgctttctgaaaagtttatggggacaatgcccccaaataaatcagcagtttacaaatagataactcagcttaagaatgggccaggtgtggcggctcatgcctgtaatcccagaactttgggaggccaaggcaggccaaccgcttgagcccaggagtttaagaccagcctgagcaacatggcgaaacctcatctctacaaaaaaatggaaaaattagccaggcgtggtggcacgtgcctgtagtcccagctactactcgggaggctgagctgggagaatcacctgagccagggtaagttgaggctgcagtgagccatgatcatgccactgtactccagcctgggtgacagagtaagagtctgtctcaaaacaaaacaaaacaaaacaaaaaacagaagccaatagcaagatgaatcacatgctggaattatctgacaaggattttagagtagtcaccataaaaatgagtcaataaggaattacaaataaactggaaacaaaagaagaaatagaaattctttggccaggtgcgatggctcacaactgtaatcccagtactttgggaggccaaggcggttaggacgtttgagtccaggagctcaagaccagcctgggcaatatggtgaagccccacctctacagaaaatacaaaaagtagccagttatggtggtgtgcacttgtggttccagctacttgggaggctgagcttaggaggatcgattcagcctaggaggttgaggctgcagtgagctgtgattgcaccactgcactccagcctgggcaacagagtgagaccccatctcaaaaaaaaattatcaacatatagatgatatagaaaaagaaccaaatagaaatgatagaactaaaaattataaatgaaaattaaaactggcctggcgcggtggctcatgcctgtaatcccagcactttgggaggccaaggtgggtggatcacctgaggtcaggggtttgagaccagcctggccaacatggtgaaaccctgtctctactaaatatacaaaaattagccgggcgtggtggcgggcacctgtaatcccatctactggggaggctgaggcaggagaatggcttgaaccaaggaggcggaggctgcagtgagccactgcacttcactccagcctgggcaaaagagcaaaactccatccaaaaaaaagaaaaaaagaaaaagaaaacagaaaattaaagctaatgcaaaaggttcaatggcagaatgaatatgacagagaagtgatctggcagacagaacagtagaaagtgtccaatctcaacaacagagagaaaatacactgaaaaaaagatggacagagtctcagagacctatagggcaacaacaaagatctaagatttatgtcactggacttctgcaagaagaggagaaatagtagtgaagaaaacatatttaaagaaataatggctgaaagcttcccaaattgggcaaaggacataaacctacggattgaagttgtgcaaaccccagtaggataaaccaaacgaaacccacgcccatatgtcatcatttaacctctaaacactaaaaacaaaggaaaacccttgaaagcagctagagagaaatgacacatgaggcataggggacactgattagaatgacagtggtgttttcatctgaaactagggaaactaaaaggaagtggcatgatattcttcaagtactgaaagaactgtcaactgagagtcctacattggggaaagtctctttcaggaatgagagggaaataaagacattctcaggcgaaggaaaactaaaacaagtctgtgttaatcagttcaggctaccatgatgaaataccatagactgggtggcttgaacaacatgaattcatttctcacagttcgggaggctgggaagtcctcagtcaagatgctggctgatctggtttccagaaagggctctcttagcagcttgcagagggctgcctcctggctgtgtccttccatggtgggaggagagagaagggtaggggaaacaagctctctggtgtctcttataagggcacttgtcccatcacaagggcccctgatgacctcatctaaacccaattacttccccaaaatcccacatccaaatactgtcacatggggggtgaaggcttcaacacatgaattttgggggagacaaaattcagtccatagcaaatttgtttccaggacatctgctgttaaagaaaggtgaaaggaagctcttcaaacagaagtgaaataacagacgaaggtgtggaacttcagaaaggaaaagagaacaacaaaatgggttaaaataggagtaaatactcttctcctcatgagctttttcattttctcatgaggtttttaaaccatatttgatggttgaagcaaaacattgtaacaacatttgatacggttttcaatgtatatagagagaacacttaggacaattacattttgaaaataggataggtaaagggatctaaagggaagtaaattcctccacgtcaattacagtagtaaaacattgacattggtggactgtgataagttacacgtgcaggttgtaatacctagagcaatcactaagaagaccatacaaagtgattgtcgtagtacattctgtgctgctgtaacagaatacctgagactggataatttataaaacacatttatttcacacagttctggaggctgggaagtccaagatcaagtcaccaacaggtttggcatctgggaagggctgctctctgcttctaagacagtgccttgaatgctgcatcctctggagcgggggaacactgtgtcctcacgtggcaaaaaaggtgaaagggcaaaaagggaggcattccctccttcaagccctattctaacagcattaatctgttcataagggcagagtcctcttgacctaaacacatcccaaaagaccccacctcccaacactgctgcattggggatcaagtttagacatgaatttttggaagggacaaaaacattcaaatcataacggtgatatgctcaaaaattatataaataagtcaaaatggaattctaaaaacaatggtcatgtacccaccccaaggaaggcaaagggagagaaacaaaggaatgagaatcagagggaacaaacagaaaacaatagtaaaatatactaatttaaaccacaatgagggccaggcgctgtggcttacacctgtaatcccagcactttgggagactgaggtggggagatcacgaggtcaggagttagagaccagcctggccaacatggtgaaaccccatctcgactaaaaatagaaaaattagctaggcgtggtggcacactcctgtaatcccagctactcaagaggctgaggcaggagaattgctcgaacccgggaggcagaggttgcagtgagccaagattgcgtcactgcactccagcctgggtgacagagcaagattccatctcaaataaaaagatgaagaggctgggtgtggtggctcacatctgtaatcccagcactttgggaggccgaggcgggcagatcacttgaggtcaggagtttgagactggccaacatggtgaaaccctgtctctactaaaaatacaaaaattagccaggcatggtgatgtgtgcttgtagtcccagctactagggaggctgagacaggagaatcgcttgaacccaggaggcagaggctgcagtgagccaagatcgcgccgctatgctccagcctgggcaacagagcaagaccctgtctcaaaaataaaataaaataaataaaaataaattaaaaccaaaagacaaagttgggcacagcagtggatgcctttagtatcagctactagggaggctgagttgggaggatgacttgagcccaagagttctatgccagcctgggcaacacagtgagacacctgtctctaaaataaaaataaaatacatttttttaaaagatgaaagataatcctagcactttgggagtccgaggcgggcagatcacctgaggtcaggagttcgagaccagcctgaccaacatggagaaaccccatctctactaaaaatacaaaaaaaattagccaggcttagtggcacatgcctgtaatcccagctactcgggaggctgaggcaggagaatagcttgaacccgggaggcagagggtgcagtgggctgaaatcacatcgttgcactgaagcctgggcaacatgagtgaaactctgtctcaaaaaaaagaaaaaagaaatcaatatgttaaaataatatctgcactcttatgttcatgatatcattattcacaatagccaagataggaaatcaacctctatccaacaatgtgtgaataaagaaaacgtgggccgggtgtggtggctcacgtctgtaatcccagcactttgggaggccaaggctggtggatcacgaggtcaggagatcgagaccatcctggtcaacatggtgaaacccccctctactaaaaatacaaaaaattagccgggcgtagtggcatgcgcctgtagtcccagctactcaagaggctgaggcaggagaatcgcttgaacccaggaggtggaggttgtagtgaacggagatcgtgccactgcattccagtctgggcaacagtgcgaggctctgtctcaaaaaaaacacattaatccaccaaagagatatagcaatcctaaatgtgcatgcactaaacaagatcatttcaaattacacgaagaaaaaatgatcaggctgaaaggagaaatggacaaatccacaattataattgaggatatcaacaccacccctgcaacaaatggaattactagagagaaattcaagcaatgataaagaagaactaaacaacaccatcaatcaacagtaacaaggccaggcttggtggctcacgctcgtaatcccagcactttgagaggccaaggtgggtgggtcatctgaggtcaggagttcgagaccagcctggccaacatggcaaaaccctgtctctactaaaaatacaaaaattagccaggtttggtggcacacacctgtagtcccagctacttgggaggctggggcaggagaatcgcttgaactcaggaggcagaggttgcagtgaaccaagatcacatcactgtactccagcctgggcgacagagcaagattctgtgtcaaaaaataaaaaacaaaaaaacagtattgaaatgacattatagaacattcaacccaacaacagaatacatgttgtttttgagtgcctgtggaacgttcagcaagatagaacattacctgggccataaaacaaacctcaacaaatttaaaaaaactaaaatcagagggagtatcttctctgattatatagaatcaaattagaaatcataacagaaagacaacaggaaaaccccctaaacacttatttaaaaacatgcttctcaataacccatgggtcacaaagtaagtcaaaaggaaattttataaatacacagaactggaaaaaatgaaaatacacctgtcaaaatatgtgcaatgcatgagtgtagtgttgagatggaaatttatagaactaggtacttacattagaaaagaggaaaggtctcaaatcaataatctaagttcctacttcaagaaactagaaaaagaagagcaaaggaacctcaaggaagcagaaggcaggaaataataaagataagaacagaaatcaatacaattaaaaacagaaaaacagcagagaaaacaatcaatgaaacaaaaacttggatctttgaaaagatcaatacaattgaaaaacttgtagcaagactggcaaagataaagagagaagatacaaatcatcaatattaggaatgaaagaggggatgtcactacagattttgcagtcactgaaaggatactgcaagttccatgaagaagaactctattctcataaattcaacaacttagaagaaatggaccaattactccaaaagcacaaacgaccaaactcaagcaatataaaataggcgatctgaataattctacaaccattaaaaatttaaatttattatttagccctcagaaaagaaatcttgaggcccagatgttttcactggagaattcctcctaacacttaaagcgaaattagtgtcaattttgtagactgtcttccggataatagaagcaaagggaacacctcccaactcattgtatgaggccagttttaccttgctaccaaaaccagggaaaaaagcatacacacaaaaggaaagctacaaactgatatctcttgtgaatttaggcacaaaaaccctcaacaaaatattaggaaatcaaatccaggaatgttttaaaggaattatacaccatgaccaagtaggatttgttccaggtatgaaaggctggttcagtttttgatactcatcaatgtcatccaccacgacaggttaaaaaaaaaaagcatatgatcatatcaattgatgagaaaacaaaaacaacccagtggccaggtgtggtggctcacgcctgtaatcccagcactttgggaggccgaggcaggtggatcacttgaggacaggagtttgagaccagcctggccaacatggtgaaaccccgcctctactaaacatacaaaaaaattagccgggcgtggtagcgggcacctgcaatcccagctactcaggaggctgaggcaggagaatcgcttgaacccaggaggcagaggttgcagtgaaccaagatcacgccattgcaatccagcttgggcaacaagcgcaaaactccatctaaaaaacaaacaaacaaaaccagttttttattttttgttttcttttttttttgagacagagtctctctctgtcgcccaggctggagtgcagtggcgcaatctgggctcactgcagcttccacttcccaagttcaagcaattctcctgcctcagactcccaagtagctgtaactacaggcgtgcaccaccatgcccagctaatttttgtatttttagtagagacggtttcaccatggtggttaggctggtcttgaactcctgactttaagtgatctgcccgccttggtctcccaaagtggtgggattacaggcgtgaccactgtacccggcccaccccagtatttgataaacgccaatacccagtcttctggttctgttcccagatggacctgcttgttcttgtggtccaataataagaagcagtcagactagaagagaagggagtttttttctgcagctggctacagagagaaggtcggagtaactcaccagacccacccaaagttaggtgttttgttagcttatgtatacaattcaaactctatgcctatgtgcaggagtgtttcttaatctaatggtttttttgttttttgtcttttttttttttgagacagggtcttgttctgtcgcctaggctggactgcagtggtatgatctcagctcagtgcagtctagacctccccggttcaagcattcctcccacctcatcctcctgagtagctgggactacagaacagcgccactatgcccaattgatttttaaattttttgtagagatgcagtctcccaatgttgccgagggtggtctcgaactcctcctaggctcaagtgatccacccacctcagcctcccaaagagttgggattacaggcgtgagccacctcacctggccatctaatcctcttaactaggggtctgaaggtaggaaactttatttctttttctttttctttttttttttttttgagacggagtctcgctctctcacccaggctggagtgcaatggcgtgatctcggctcactacaacctctgcctcccgggttcaagagattcttctgcctcagcctcctgagtagctaggactacaggcacatgccaccacgcctggctaatttttgtattttttggtagagatggggtttcaccatgttggtcaggctggtctcgaactcctgacctcgtgatccgcccaccttggcctcccaaagtgctgggattacagacatgagccatcgtggctggccaagtttcttaatcttaatcctaaatgggttttggtaggggtcgcatgtgtaggaatgcttttattactctatcaggttttgagattgagaaatccaggaggggttttcatggtttgtttttgcatttcagctctggcactcaggcaccagttttcccaggtcagtattcattttttgctcctgctttaatgtttgacttatacactcatcattacaacaaagggcttatggagacctgacctgccacagttcctggaaaagacggagtggatacactcctccctgtttcgcctacaaagtacagctgaaaccaatggatgttacatagaaaacaagcttgagaagactgcaaggtacagaagagccagcagatggctagggattcggaatcgagaaatgacatggtgctgagccccgtgggttttcttatgcattcaagaccaggtgctggagaaagcagcaacgcagaacaccaagcggtgcagaaaaaaaagactcaggaaagcctggcgggcacagtggtgcgtgcttgtagtcccagctatccaggaggctgaggcaggaggatcgcttgagcccaagagtttaaatctaacctgggcaacatagtgagaccctcatctctaaacaaagaaataaaagacccagagacctggggaaacctcttccccttagccaaaggaccaggtaaggggcagcctcctaagagggtgtgaaccaaaaagtatcccagacaggtctcaatcagttttgaagtttactttgccaaggttggccgggtgaggtggctcacgcctgtaatcccagtactttgggaggccgagctaggcggatcacttgaggacaggagttcgagaccagcctggccaatatagtgaaactgcatgtctactaacaacaacgaaaaaactagccaggtgtggtggcacatgcctgtaatcccagctactcgggaggctgaggcacgagaattacttgaacccaggaggtggaggtcacagtgagccgagatggtgccactgtactccagcctgggcaataaaagcgacactccatctgaaaaaaaaaaaaaaagggccgggcgcagtggctcacacctgtaatcccagcattttgggaggccaaggcgagcagatcacgaggtcaggagatcgagaccatcctggctaacatggtgaaaccctgtctctactaaaaatacaaaaaaattagccgggcgtggtggcaggcacctgtagtcccagctactcaggaggctgaggcaagagaatggcatgaactcgggaggtggagcttgcagtgagcagagatcacgccattgcactccagcctgggcaacagagcaagactccgtctccaaaaaaaaagggccgggcgcggtggctcacgcctgtaatcccagcactttgggaggccaaggcaagcggatcacgaggtcaggagatcgagaccatcctggctaacatggtgaaaccccatctctaccaaaaatacaaaaaattagccaggcgtggtggcgggtgcctgtagtcccagctacttgggaggctaaggcaggagaatggcgtgaacctgggaggtagaggttacagtgagccgagatcgagccactgcacttgagcctgggcgacagagcgagactctgtctcaaaaaaaaaaaaaaaaaagttatgtattctgagtgttttgagaaaaccaaagctttagcagaaaaacacctgggaaagcttcaccagaaaatctttctccaccacaacaatgctcctgcctactcctctcatcaaacaaaggcaattgtcatttcatttttccacactttttgaagtccccttgtattgtggctattcatcctttgtcaaccatatgtgtttgaagctgactatgtctttttgggtagacatatctgtatgtcggtctaggcagatgggccccacaaaaccactgcactcccgttatggctgggaagagcaagcaaatatttcctatgcctctaggggatacagatttaaccgagagttagacctggaagtaccccatagtcagtttgagggataaagcaggagcatcatacatgagtcaacatccaaggaccacatagtatctggcacatctcagaagatgcctgtgttggccgggcacagtggctcatgcctgtaaccccagcactttgggaggccaaggcaggcagatcattcgagccccagagttcaagaccagcctgggcaacatggcaaaaccccatctctacaaaaaagtataaaaattagctggatgtggtggctcacgcctgtggtcccagttactcgggaggctgaggcaggagaatcacttgagcccaggaggttgaggctgcagtgagctgagatggcaccactacacttcagcctgggtgacagaatgagaccttgtctcaaaaagaacgaaagaaggaaagcctgtttgaactgaaagggggctaagtgggggacagatcctaaaggaatcctttgattttgtagatggaaaacataacatgctcattatttcactgaaatttaaagaaaattgactatcctttgtattttgcaataaaaagttagctccataggcctaaatgtattttctttttaatgttcacctaattaaattccagatccagacactagccttaataatgattgtctttataattaactaaaggaatctaagtttccttttggctgtggggggagagagtccaatctccatcataaagtttgtttacaccatctgatttggtgaagtgttgaattgagaaactttgacaagaatgtctgtcttgagtccctgtacaactacagaaccctctgaaatgcccaggatcgttaccaacgccatctccattaagtcaagtctgtccacagtggggagagcaaaaggttggttaacaaatacaaaagtacagctataggccaggccaggctgctcttgcctgtaatcccagcgctttgggaggatcacttgagcccaggagttcaagagcagcccgtgaaacatggtgagatcttgtcttcaataaaaaataaaggccgggcgtggtggctcacgcctgtaatcccagcactttgggaggccgaggcgggcggatcacgaggtcaggagattgagaccatcctgggtaacacagtgaaaccccgtctctaataaaaatacaaaaaaattagctgggcgtggtgccgggcgcctgtagtcccagctactcgggaggctgaggcaggagaaaggcgtgaacccgggaggcggagcttgcagtgagctgagattgcgccactgcactccagcctgggtgacagagcaagactccatctcaaataaaataaaataacataaaataaaataaaataaataaaaaattatccaggcatggtggtgcatgcctgtagtaccacctacttgggaggctgaggcaggaggatcgcttgaacccaggaggttgagggtgcagtgagctatgatggtgccactgcactccagcccaggcgacaaagtgagatcctgcctcaaaatgaaaaagtcacactgtaccccataaatatttacaattattatgtgtctattaaaaataataggctggggccaggcacagtggctcacatctgcaatcccatcactttgggaggccgaggcaggtggatcacctgaggtcaggagttttagaccagcctggccaacatggtgaaaccccatctctactaaaaaaaaaaataatacaaaaattagctgggcatggtggtgtgtgcctgtaagcccagctacctgggaggctgaggcaggagaattgcttgaacccaggaggtggagtttgcagtgagctgagatcacgccactgtactccagcctgggtgacagagcaagactctgtctcgaaaataataaaataataataataataataataataggccaggtgtagtggctcacacttgtaatcccagcactttgggagaccaaggcgggcggatcacttgaggtcatgagttcgagaccagcctggccaacatggtgaaaccccatctctaccaaaaatacaaaaattagctgggcatggtgggatgtgcctgtaatctcagctactcgtgaggctgaggcacgagaatcgcttgaacccaggaggcagaggttgcagtgagccgagattgtgccactgcactccagcccagggaacagagagaaaaactgtcttaaataaataaaataataaaagcaaaaagaggaatgtttgtccttgaaattattactttagcaaagaaggctcataaaaccttcaaatgacacctgtagttataattgagaatatgttgtctatgttgtaaatgacatctctgaaactctaagtgctgtaaataaggattttgaactcctggcctcaagcgatcctcccgtcttggcctcccaaagtgctgggattacaggtgcgagccactgcgcccggccgtggattttagtcccagccttgcccctctgaggcagtgtagtcatgggaagttgcttcgcctttttgtgtttcagtttcctcaagtgcaaatgaggacaacaaaaggcagttttgtgtcacctcagacgtggtcctaaatgggcccaccgggatggttcgcattttttaacgtcagagcatcaatctctaaaggtctgcccctaggttggggtcaggggtgtcagagctgccctgcctgtcaagccctgttctccaactgccactaagagagcagcggaaataggaacactgagaccagcagcccgactcaaggtgaagtgcgtgcacctctcttccgtctcccttttgctcctcctgcctctgcattgactccatctcttgctcctctgtatccgttttaccttctcaatctcattctctctctgctcctgtttttcttttttccctgttacctctgccttgtgtctttgccaatgtgtctttctccttctcacttttttttttggacggattctcactctggctcccaggctgaagtgcagtggcgcgatctcggctcactataacctccgcctcccgggttcaagcaattctcctgcctcaaccgtgcaagtagctgggattacaggcgcccgtcaccgtgcttggctaatttttgtatttttagtagagacggggtttcaccatgttggccaggctggtctcaaactcctgacctcaagtgacctgcccacttcggcctccacaagttctgggattacaggcataagccactgcacctggcccctccttctcactttttttttttctttttaagacagggtctcgttcagtcacccaggctggagtgcagttatctgcaacctctgtctcccgggttcaagcaattctcctgtctcagcctcccgagtatctgggactacaggcatgtgccaccatgcccagctaacttttgtatttttagtagagacggggtttcaccttgttggtcaggctggtctcgaactcctgacctcaggtgatccacccacctcggcctcccaaagcgctgggattacaggcatgagccaccacgcccggcctcttggtatctttttctgcatctctctctcctttgatctctccgtaaactctggcttctctttctatgtctttctccctattctctttctgtccctttgattcccccatgtctgtctctttctccctgacctgtcggggtctgtccctgaggaagtgagtaaagtgatcccacacctgtcagggctggacccccttgctcttctctgatcccacccacctccttaacccctcttgcccacagactatttcccttctccccatgcagacaggtgggtggcaaactcaagggccaccggggtcacactgtgaaagcaccagccagggagaccaaagcaaaaaaaatgaggatgcggagctgagagatcaagacagatagaggcagagactaagggcttaggcagggaggaagcaggaagaaacaggaggaggaacctgagacagagccgctgaagtccttgctggaagcagatgggattaaatgagcgacgagactgggagagtgccagagagagacaccaagaggatgcaggtaaggcatctgtcccctgaggccccgcagctagggtgtgggtgggcggcagccggaggaggcccggcctgaagccagctcacagctcacccgctcctcactatgtctcctgtgtttgcctgcatctgacgtggtattcccctctacctgcctgcgtttctgaccctcacgcagcttcttctatttcttagcgtctctcctcctctctgtctcttttcattgatctcttgcgtgtctctctgcctccatctctttccacctctctgtcggtctctacctccctacgtgcatgtctgtttctatttctctccctctctttatctctccatcccccgtcttcccttggtctctgtagtctcttctcgtcgaaacaaccaagggtctcaccccgtatttccttcttataggaacagaggccgccggccccgggcctaggtcagtcagagggcggggcctcagggctcgccccagccgcgcgccccagctcgcgagccgcggacgacccagggcgccccagccccagctccgggcctggtgagcctgggtgatgccgttgacgcgaggcctccacggagtcccccctcccccggcaccgtccccagcctccctgcaactctcacgcgaggcccctagcctcggtttcccagcccgctccctcgcttctaaacgtggtgctgctcccgccccactccaggtgactccggccccccagccccgccccagccagcggccggaggaggccccgaacgtcgccgcaagcggtcaagccacccgggccgagggcacgcagaaggaccgctcctaggccccgcgggtgggtccggccgcccgcagcctggagactgcgcagctggacccgcgcgcgggagaggggcggggcctggcggtgggaggaggtgggtccagaggctgccgagggcgggagcctgcgggtctcggggagcgtggagaggcgcagcctcggaggagccgggtggttgtaggaaggaggtggggcccgccgcgggctcaggggacggtgttgagcgaaacgaccagggcgggtccgaggggcagggccggagaccaagggagcgtggagcctccaggactctcggaagggaagggcctccaggagctactctccaggggcggcgctagatccacgcaagtgaaggcctgcagggggcagggccggcccaaagatccagaaggggcgggactaaaggaggtattggccccaggacacaaggaacaccctgggtctgactggcgctccgatctcaaagatgcatgcctggtgctgccgccgcggtacttgtggagatgcgggttcgaggcctaagcccgggccccgcgctgccctccctggtccctcagtggcgtggctgcgccctgcccggcattgagtcgctcaaacaggtatcacagctgtcaccgctgaggactctttacattcccacggaccagttttgtaagggactggcttgcaagaaagggacgtttttcatgtctctcgaggtattcgccactggagcagtttgtgcagaggaaacccttaactcctcaggaagcttttgagcctccccgtggcttctgcaccccagtgtaggcaatgtttgccccacccaggtagagcttttcgcagaagtcacagcttgggggcgggggtatgtccacccagaaaaatctcctagctcccccatcccaaaatgaaaactcatttctggttattttgtggttaccctttaaaaacactagacctggccgggtgcggtggctcacgcctgtaatcccagcactttgggaggccgaggcgggcagatcacctgaggtcaggagtttgagaccagcctggccaacatggtaaaaccccgtctctactgaaaatacaaaaattggccgagcgtggtggctcacgcctgtaatcctagcactttgagaggccgaggtgggcggatcacttgagatcaggagttcgaaaccagcctggctaacatggtgaaacctcgtctctactaaaaatacaaaaagttagctgggtgtggtggtggacgcctgtaatcccaactactcaggaggctgaagcaggagatcacttgaacccgggaggtggaggttgcagtgagccgagatcacgccactgcactccagcctgggtgacagagcaagactccgtctcaaaacaacaaataaaaacacttgaccacactgagcagaggaaagcagaaaagcagctctgtgacagaaggggaggctgatccagggcaccttctttgaaggagctaggtctcctggcccccttcttccatcccagatccaccctgaggccacatggagggaggggaatcaccttcacaaatgccgtgctgagtgtccagaaagaagggactcctgtgaggccacatttcccagcctcggtgacgggggcttgtggaccaggagtcagggatattggagtgtgtggggggggatggggtcaagggtgcaacgtccagaaccacccccatccccagcaatcctggtgttcattcacttctttcccaagcttgttcctctgacagctaggacccatcaccaggccccagacaaccttattcatgtccctaattcacatcttcattctcccttcctgctcatccatcccatagacatttactagagcccacttgctgtgggcctccaagtcctagggcttccaagtccctgaagcaggctctgcccctcatcctaaggaggggccccataggcagttcaaggagtccacacataggcatttcaaaacgggctttaaatactcatcagggtgccacacaaaggagctggggtgagaacttcgtacatgtgagtgtggggctggggtgccctgagagagaaaaaggggacccatctgtcagggcagctggggtgccccacccccaccctgggactagggagcagagtagaaaccctctctggagggtcccagggctaactgggagccagccctcccttcgaggtagaccatcggggagggaaccgagaagtagctcccatggtggcagtggcttcctcagtggtactgctgatagctggggtagcctggggccggggtgccatccttagggggcagctggctggggtcctccaggaatgggggcgctggagaagggagacttgggtaaggatgagtggaagaggccaggtggagtatttcccactcccccgaccaccagttactcaccatttcggaactgctgggctgtgtagcgagtgaggaggatgccaacgccctcaatgagggccaacaggatgccccccatcattgctgagcccaccatggccagtgggccacctgggggagttggaggcagagaaacagaggtgagagcaggcagaacagggtggaaggggctggggccagggccaggggtcactcactgcgggcagccagcacagccccggtcaatgctccactggtgatagagttccagggatcctccttgccccgaagccgcaccaggccacagtcaatggtggagaacaggcccccccacactgcgaagctacctgtagtggaaccgaggcctaattagttcctgggaaatcctgagaattcacatctcaggggacttccaaggcctgaatgctttggccaagaacagggagaaaaacccagacacaaaggcagatagcaaacccacacagagtatttcctatctgtccccatcctgtggtagctcccacttcaagccgtctataatcaccatcaacattcccttcatctttatggggagttgacaaatgtttacaagcagatttatcttcatatggcttttaacagagcaactttgagcttcataatcaccacacagagttggaattctgatttgggtttcagtgagaaggaaataggttaggaaacccagttaatatgatagttaaaatgtttactgagggcttactgtgtgccaggacctgttcgaggtgctctgttatttgacttctgcaattttaaattagttaatgttattaaagtgtttagcatagcaaccagcacttagtagtatgtaaattacataaactataaaactaccgatgaaatggttactgttatcaccacccccacggtacaagtgaggttcagagaggttaagccactagcccaaggtcacatggcagggaacagtcaggacctagatttaaactccagaacccactttcttcccctccatattcaattgttgggaaacatcacccccctagaaagtctctggcaggggctagaatctgaacccctaacttgcagcctagacccaaaggatcaaccactcccacctttgccaagacatctcctatatctatctccccaagtccctcacctccaatctggggggctcggatcctcacagcattggcactacctctcaaccggtgccgaattccctggggaaaggaaggaagggcgttagggcagggctgaagccactggcagacacgtttccaacttttaagagagggaagaagatgggagacctgttagaggtatgagctgtagagatgtggagaagtggccaagaactagtggcctggagagcgccccaacatgggtgttctcagagctaggttgagaagtgctaattcattcatacatttgttcattcattcattcagtgaatgattaacaagtacctactatatgtgccaagcaccatgccatatgcagggatacagccatgaacaaggtaggtctgctctctgccctctcagagctcacattaacggtgggagacacagatcttgagcaagagtagataaacaagggagcttcagacagcaatctgcactgtagaggaaatgccatgaagaaatatgactggggctgaggggtcaggaaaggcctcttgaaggagggggaatctgtgctgagaccttgaggatgacaaacttgggcaaagatccagggaggagagttccaggagtctaggggagggacggggctacatatataaattgcagagaccttggctaatagatggcatttaaagtcatggcatttgcgatcttctgggaggggaggtggtcagagaaaaagaattatgttaaaagaattctctcaacttcaaggctgtcttccgtctgccaattaaattcctgtcattttcctctatccgggtttctgagccagaatctgcctctaggtaaaatgcgcagtggctaacacctgtaatcccagcactttgggaggctgaggtgggtggatcacttgagttcaggaattagagaccagcctaagcaacacgttgaaaccccgtctctacaaataaataaatacatacataaataattagccgggcatggtggcgcagtcctgtggtcccagctacttgggaggctgaggtgggaggatcacttgagcctgggaggcggaggctgtagtgacccatgatcaggccactgcacgccagcctgggcaacagggcaagatgctgtctcaaaaaaaaaaaaaaaaaaaaaaacatggccaggcacagtggcacacgcctgtaatcccagcactttgggaggccgaggtaggtggatcacctgaggtccagagttcaaggccagcctggccaacatagtgaaaccccatttctactaaaattacaaaaattcgtcaggtctggtggcacatgcctgtagtcccagctacttgggaggctgagacaggagaattgcctgaacccaggaggcagaggttgcagtgagccaagagcgtgccactgcactctagcctgggcaacagagcaagactgtctcaaaaaaaaaaaaaactgtctggctttgcacatacatttaaaatttggtgatgactctttgaacgacacagcatttccacagaggagctccagttgggtggggtggagggtggaagacagaggccatgtttgcaatccctacaaaatcccagatacaggagccaggctcggcacatagtaggtgagtgggcaccagaatgaataagtgcacgtgactggcagctccaagcagttttcagagcagcctcccttgtgggcaagatagctaaccccacaccaacccagggaaggcctggactcacaacaggggcattgcggaaacccttgatggcctggaagactccgccaccgatgacacccatagtgaaggctccaccgcaatcatccacaattcgccatgggctgcaagcaggaagggaaggacggggttaatgtgagccctcccccaggtcctgtcacacgaactcttttctaactgggagaaaccaagtcaccagaatgggaagttcctaagtaggaacaaacacttcagataataatgagctagttctgtcacgctttttccacacacccccccattaaagcgagaaatggggcaaagggggagaaatattagtcttcgccctgtctaccaaccaaggaatcagccaacggttttactgtgatcaaagattaaatgaattggcacacgcagagttgacgtttcaataagcgacataggcgtgttaactagccaagacagactgtcagcaaagcaggaccgcgtcgcaccccttctccgacggtgagcccgtccaaccatgccccgccccttttcaatccggcacaactgggaaaaaccaagagcgaccgcgggaagcatccaccgtccccgccggccctcaacaggttcatccgtgccccgccccccactgacaaaggcgacctgggaaaaaccactggcggcaactctggggatttccggtcaacaccgtaccacccctagccgggatggatcgtccagcgtgtcttttttcgttaacagggctaggagattacgaagtcaggagaaacatggcgtggttcggccttcgccgcaccttctctggttgtggcccctcataacggagcccgaatgacaggaaccgagtgggggtagcgggagatacgttaagagtcccccgagtctggtacatggctctgtgcggccgatgcctcccccgcccgacccccacggctggccttggcgtcgcagcaatattccggatgcctgtgcccattgccgtaccagggctcccgagcgtactcctccatggcgctggcgtctggccgcgcagtcaggccacgcccccagcgtagacgcacaccggcgtcggagctttccgcctattaccgggcagcgattgggtcgctataccgcatgtcacgccaaggacgcactctcattggccaatcgagtttctgccatttgttcattgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtgggtgcactcttttggagctggaggaagtgctgccctctgctcccccatcccagcgctttggtttctcccacccggcagtcatggggacgctggatgagcccatttctgaagtgcggaggggccgggcttcttaggctgtgggcggagcctgggcctgggagaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctggtgagacagctaaaagcagatggtcctaacacgtgccagcctcgacaggcacttttgttgttgatactgacgcttgatacctagcatgggccaactgtgcaccaagcaatggggtggcaggcatttttcgttgttaacaatgtggattcctgacatccatccctaccgcgtgtcaagtggagggggttgggggaatagatatttcattctttttttttttttttttttttttttttttttttgaggcagagtcttattgtgcacccaggctggagtgcagtggcgcgatctcggctcactaaaacctccgccttccaggttcaagcgattctcctgccttaacttcccgagtagttgggactacaggcacgccccgccccaccacacctggcaatttttttttttttttttttgagacagagtctcggtctgtcgcccaggctggagtgctgtggcgtgatctcgtctcactgcaacctccgcctcccgggctcaagcgattttcctgtctcagcctcccaagtagctgggattacaggcacgtgataccacacccggctgatttttgcatttttagtagagacgggtttcaccatgttggctaggctggcctctaactcctgacctcaggtgatccaccccccacccttggctttccaaagggttgggattacaggcataagccactgtgcccggcagatatttcattcttaacaatactgactggctgggcgtggcggctcaagctggcattcccagcactttaggaggctgaggcgggtagattgcttgagtttagggattaagagattagcctgagcaacatggcaaaaccccgtctttacaaaaaatacaaaaattaatcgtgtgttgtggtgcatgcctgtagtcccagctacttgggaggctgaggtgagaggatctcttgagcctaggatgtcaagggtgcagtgagccgagattgtgccactgcactccagcctggccgacacatggagaccctgtctgaaaaaaatccaaaaaaaacaacaaaataatactgaccacctaatgcctatttggggcctactgtatgccaagttaaatcccatggattactctatgggggtgatgacatagtatctaataggaagtactgctaacctctactgctgtctcctgtgtgccaagcgtagttgcagtgaggatctatcatttaggcctactgtgctctggctgcaaatcacaccttattatcagtaatactaaaaactggcatctatttggggctatagtgtgccaggcactggaaaatatatcttctccttattgataactgacatctattacaagcctactgtgtgcaaggtatagaccttgtggttaataaaattgtcaatgatcccaggccgggcagggtgcctcatgcctgtaatctcagcgctttgggaggcggaggtggacggatcacgaggtcaggagatcgagaccattctggctaacagggtgaaaccccatctctaataaaaatacaaaaaacttagccgggcgtggtgccagatgcctgtagtcccagctactcgggaggctgaggcaggagaatggtgtgaacccggaaggcggagcttgcagtgagccgagatcatgccactgcactccagcctgggcaacagagaaagactccatctcaaaaaaataaaactggcaatgatcattgatttactttttttttttttttttttttttttttttgagagagtctcgctctgtcacctaggctggagtgcagtggtgcagtcttggcccactgcaacctctgcctcccgggttcaagcgattctcctgcctcagcctcccgagtagctaggaccacaggcgtgctccactgtgcctggctaatttttgtattttttagtagagatggggtttcaccatgttggccaggctggattttcttttaagcctattgaatgacctgtgcctatggtatatatattatttattatttgtttagagacagggtctcactctgttgcccaggctggagtgcagtggcacgataatagctcactgcaagctcaaagtcctgggctcaaatgagcctcctgcctcagcctcctgagtagttgggactacagacgtgtgccactgtgcccagctaattttttttttttgtagagacaggggtctcactatgttgaccaggctagtctcacagacgggttttcaccatcttggccaggctggtcttgaactcctgacctcgtgatccacccactttggcctcctaaagtgctgggattacaggcatgagccatcacgcctggccaagatgagtaaattttttgatgaatccctatcaactctgaaaccagatagctttggctaacagtagaactcatcatctgaacccagacacagatttaggtaacctttttttgtaaacctcctaatatagagagttggatttggaatgtgaaagatacttcatattcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggcctggctcctctggggttggaagactgtcttttctctcttttttgaaacggagtttcactcttgtagcccgggctggagtgcaatggtgtgatctcggcttatggcaacctccgcctcgtgggttcaagcgattctcctgtctcagcctcccaggtagctgggattacaggtgcacaccaccacacccagctaatttttgtattttttgtagagatggggtttcatcatattggtcaggctggtcccgaactcctgacctcaggtgatccgcctgcctcggcctcccaaagtgctgggattacaggcatgagccaccacgcccagctgacagtgttttctcttcaggagaagagattctggggatcctgcctgtggggtcctgacatggggcaggtataggcagagactggggagacaagagttgaggatccaaggcaaggacatctgtgctgacacttctttcctgcggccccacagcgggctcccttactactggaatgcagacacagaccttgtatcctggctctccccacatgaccccaactccgtggttaccaaatcggccaagaagctcagaagcagtaatgcaggtgagttggcaggtacaagcgtgccttgagtgatcttagcagttctcacggagaggccaagtagaatgatagtggatcagaggggcaggtgagaccaggcgggcccagcctcaggcaagggaggttgttgaaggcagaggctgctgggtcctggggtggcaagaggtcacttcaagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggtaagtgacaacccctcttgactcagtacgtggacaccatcctccggcctccttcctccattcctcattgggaccaggtgggctgtgtccgccacatcacccatccccatcccctgactctttcaccggcaggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccatacctgagtgcttcctttgaggctgcccaacccaagtcggcaagatacacaacacattttatttgcaaaaactcagctaagagatagtgtggagctggcaggggctggggggctgagctgaggtgggtcatgagagagcttagtcatgttggccctgggtggggcaggggtggtggggacagggagtccagtgtctacctcactctacccctaatactgatcagagtttggtcccagctgggccaagggcaagaagagagaacgaggccaggccaatgtcttcaatcccagcggctaggaacccttcaccttggtgagcaacctgtggtgggaatggggaggaaagaaaaacacaaagctgggctaggctggcaggcgggtttcctgagcaagtgagggcggcggtggtgaggctggtagtcctggggttagtaatggtgcccacctggtcagaaagctacacgtggactaaataaatacaacatctttatttggcattggatatcctgacatttgttcattacagttccttaaaaaacaaaccaaaaaatcagaacaaattaatcaaaaataaagatccaatggctctatttacatatagcaaagacagcccaggcatcttccatgcacacacacaccccgccccgatacagttaaggggttaataagctttggggagcgcaggaggcaggttccacagttcatcaatcccaagacacccccatgaggtaggggtgcctcacacagccagacggatatcaagagtatgattggtagctttttcctctcctagacatctccaaaaataagcctacatctggcaactgacagtgtcttaaatacaatgagattcagccacttcaaggacctccatttttcccacaccctggatcattaatgatatgattacaccacaaatcccaagtccactaaaaaaaacaaatggcccctaccacaccttctgccagaagggctgatgcaaaaatcttagctcttgtccctttctccctggggactcacaagaagcccatcttcaaggtatcaaggaagctggcccaaggccacacaaaagacggaactagtaacatgatccagagcggtggtaagggaggagagaaggcctcaaactatgggcaactgaaccccacaggtaggcatcggtcattcctgaagagctgcgggagttttgtccagtgtgtccttatggaggtggagggactgctgggagggactctcccagacgagaaacctccagaagagggcacagggtcggggagggagcagacaaaaaaaaggccttgaatgacaatacccccaaccctgcctccaaagaggttagagggagcagaggcggcagctctaaaaccccctccaggggaagggggtcaccctaccaggaagggttcacgtgacacccagctctagtcccacacccctccagaagtctcagtgacctgggagaaaagaccatctcccaaacccagaggagccaggccccggagggtggcgacttgggtcctgcagatgcccaacaccctccaccccagtccccctcccttgtgtccccccattgctgccagccctcacttcaccagcactgactttggcagaaagggctccgtgatgaggtctccacggtgggaagacagctgcggtggtggtggctgcccgggaggctgctggtgaacgcagggcccggaggcggaggcagaggcagaggctatggctttggctgcacctcggggaaggctgtagaggtagacagcaccaatgacgagtccagcgccaagggcaaataatgggtccacgtggaagccaaagaggcgaatggaggcaacagtggacagcacaatggacagggaggtggcaaagcccttgaggatattgtcagcgtacttgacaaccacagccaccagtagcccgccgaaggcctggttgagcaccacgccccagacagcaggtgtgtacccaaaaaagaaaccacgggtggccacggcggtaccctcagcccaccagagccccaccaggcccagtgctgtgccgaagaggcccagttgcaggttgcgcagccacacggagcctgagctgcctttgaggatcttctcaaagtagacacctgcgaagccggaggagagacaggaggccacgacggctgccaggcctgccccagggttctgatccagtggccgtgggcctcccccaccggcttgctgtgcctggacaatggcgacgccagtgaagaggagcagcagggaggcccactgcagccgggaaaggctgcgattcagcatgagcacggagaacagcgctgtggtcaggatcttcagctggtatgtcacctgcgagtggcacgtggaaggcactgagggctgaccctggcccccaacaggtgcacatggggggcagcacccactgtgggcccccaggcacaatggagggacagggtggggggtatgacagcaaaaacagcaaaaggagccagccactggccattggctgagctgcagcaaaacagttctgaagtctctcccagcaagtgcacaaaaggatggctgtgccaagaagtccacatcccaatcccatttcctggctgtgtgactggggacaaagcacttgccctgtctgagccctggcatcatcatctataaaagatggctgaggtatggaagtatctttgtgatgagggacttgatacaaatgaatcaatagccacaacaatgtcagcaaatacttacatagtgcttacaatatatcagtgtggttctaggcactgcacgtgaattcattcatttaattctcacaacaccattctgaagtgagcaccactgtaagccccaatttaaaggtgagaaaactaaggcacagagaggttaggtgacgtgccccaaaatcacacagctggaaggtagcagagctgagatttgaacccagacagcctggccccagaatccaggctctttaaccatttcacaaagctgcccacaaatagcctaaagcttatctgtcaccaatcaagggctcttcacaggtattatttcttttaagtatcctagcatctcaatgaacaggcattactatttccacccccaattttcacagacgagaaaagggaggttgaaggagttccaaggacattctgaaggtgacatagcccctgtcctctgcaacacccccccaccacgctattcccatactccagtccccaacccagttagttcctctggggccatgctgggcttggggctcacctggaaagtggcagctggtaggttagagatggcaacatactggaggttattctgcaaggtgtagatgagagagggcactgcgagcttgagcgtgtccacatactgcaccaggacagcctcatggaggaagagaaccaggtgcttcacgttacctaggtgggaggaggagagcccttcttagcactgacagccatacatggggaacccctgaaggctgggaacaggccttgctcctgtgactcccccatccaccctgctgtccaatccctggaggctggaatgaagtatgtgatcttggttttccctagagtacaaccatgtttccagcaagcttttctgagactcagtttaatggcagcaaaagaatcagccatccgtgtctgctaatcacagagcatgtcactcatgttagagcctacctccctggcagagagccccattcagggaaagcactcaatactcaatatatttgtgtacaatgaaataaccagcattaggccaggtgccgtggctcacgcctgtaatcccagcactttgggaggccaaggcaggtggctcatgaggttaggagttcaagaccagctgggccaacaacactgaaaccctatctctactaaaaatacaaaaattagccaggtgtggtggcaagcgactgtaatcccagctacttgggaggctgaggcaggagaattgcttgaacctgggaggtggaggttgcagtgagctgagaccatgccattgcactccagcctgggcaacagagtgagactccatctcaaaaaaaaaaaaaaagaaagaaagaaataaccatcattaacttggagcttatgaaatagaagccctaggagctggggtggagggctgtctcccacacagaagagtttagtctagactttttttttttttggcacagtggcgcgatctcggctcactgcaagctccacctcccaggttcaagccattctcctgcctcagcctcccaagtagcttggactacaggcgcgtgccaccactcccagctaattttttgtatctttagtagagatggggcttcaccgtgttagccacgatggtcttgatctcctgacctcgtgatccgcctacctcggcctcccaaagttctgggattacaggtgtaagccaccacaccaggcatagtctagacttttagacttatcctagctcctcactgacccatgtgccgtctgagggcaggggccatctcccccttgttgcatctttctgtcagccctagacacagagttgcctctgccacatggatgaatgcaggcttgaccattaagcagaagtccgcttgggacctgctccagtgaaaacatgataatcgggctgggcgcagtggctcacgcctgtaatcccaacactttgggaggttaaggtgggtggatcacctgaggtcaggagttcgagaccaggctggccaacgtggtgaaaccccgtctctactaaaaatacaaaaattagccgggtgtggtggcaggcgcctataatcccagctactcaggaggctgaggcaggagaatcttttgaacccgggaggcggaggttgcagtgagccaagatcgtgccattgcactccagctcagacaacaagggcaaaactccatttcaaaacaaacaaacaaaaaacatgagaatcatttcctatgtaacaaggcctttgcaaagctcgccccactttttggcagttcatctttttttttggcggggcggggtgggtgggtgaggagtcttgctctgtcgcccaggctggagtgcagtggtgtgatcttggctcactgcaacctctgcctcccgggttcaagcaattctcctgcctcagcctccctagtagctgggattacaggcacctgccaccgcgcctggataatttttgtatttttagtagagacggggtttcaccatcttggccaggctggtctctaactcctgaccttgtgatccacctgcctctcggcctcccaaagtgctgggattacagacgtgagcaaccacgcccagccagcagttcatcttttaagtcacagctgggtgtcactccacaggcaaaacttcttcaaacactgaacaaggttgtcccaggaactcctactgatgttcattcaccaaaccctgtgcactcctggtctccaaactcgaattcaggggaaaaaaattccgggcaggggagagaggggtgctgaaattgtggctaagagatgaaggcctgtgattaagtctgtggctatctgttatttccatcttccatcagcaatgaggacaagctgctcctctgcattgctaacccatctacccccacggcctgaggcagtgttcacacctacactgttcacagagttaacaaaggtaagagcaggtctcttgttaacctggagttaacaggtgggtgagaatattctcttcaatgtaaacaaagggcaaaggtgcataattcatctccatccctttacttatgcaagacctttttagagaaacaattgggcaacacttcaaagtagaaggccttcagggagatgttgaaattagcagataaacccaacttccaatttacaagagatgtagaagacagaatacttgttaaatttttgagaatatttgccttagggaggcagtcagcaaaatccagactacccaaagtctacaaaacaaatgacctgttttctccaacaaattaattgcaaagaccaaaaaacccctagagattaacagatttagaagataccaaacaaggccagcctggtggctcacgcctgtaatcccagcactttgggaggctgaggtgggcggatcacgaggtcaggagttcgagaccatcctggctaacatggtgaaaccccttctctactaaaaatacaaaaaaattagctgggcgtggtggcacgtgcctgtaatcccagctacatttattcaagataattcaggggaatttacttccatacaatattacttcgtgtgggatttacttaaaaataataagaggataaggacgtaggtagacatatagattggcagtgagtgaacaatcactgatgttgtttaaagcggccatgagttgctaattgctgactctgggggatgggtacatggatattttactatttgattattctctctgattttgcatgtattcggaattctccataatatgaagctaaatcacatgtgagagatccctgctactttataagcattggcaatctcactcctacagcccacacaggccggctacccggctgttagggctagaaaagtgtaagatgccgctacgcatagctggagtggcgctccaggcaggttgagatttggagacactcctgaagcaaaccatctgtgtgaacacacacacatacatgtggagtctcacccaccgaccccagtgcagccccatccctggttcgtacccctcttctgtgcgaagagcagcagcaggcaggtgagacctttgagcacttccgccatgaccacagcagtggtggcaaagaagcggtcccctggcaacgtgcgggcgtagcggatgctgaggatgagggaggcattctggaccaccagcacagctagggatatgtacttcaggcgcctgtgagctgtggggaacggaaggggcaagggggaaggacggggtcagaagccgctggggcatagccacaccaccacccaccccctttctttctcacccaggaccctcctagccatggctacttgctccctcagcctgcctgccctcacccaataagggtctgactcctaccggcttactgcctcagccatgagcaggaagagccagaagggagaaatgggccccaccctgtcccagtccatacctggaatccttactgaggtgtcaggtaatggctgaggcaaaccctggccacgcgcctcggcttcctcccaagtgagaagcaactcttccccagaaagaataccgacaactacattctccacgtttattgagtgtttactgtatgcctatcactgggttaagggatttctatggattacctcaatagactcatatcactgtcatctccaaaagaactgcgaggattcccatttatggattagcaaactgagaatttatatgaaatgatgctcctgtttaatgagggactgtctcatgtaaagaataacacatcaatgcagggaatgaggccactgtatgaggtatgttcaccccctaagaacggtctttctcctatctaagaaatgattcgattccctcacactgagaatggcctacatcccatatggaatgatcctcctcatacccagaatggtctctccaacccctcactcctgtgacaactggttcctctcgaaccagaatagtctactaaatacaagaaatgattcccacatgctcccagggactgaatcctgtatcaggaatggttatcccaccaagaaaggtctggctccctcaaccagatgaggaaatacttccctgcactccacatggtctgccctcccaccaccgcacacggaccctctagctaatgaatttttccttgctctacccacactcacaatgagctctctctgctataaggaaggacccggcactctcagaacgttctttctccaccatataacgatgagccctcccacccgaatgtacaatgaactctacctccattaggagggagcccccagaacggtctcctccgcacataatgaaagacacccccatcctcaaaatggaccctctctagtcacataaagaaggactcgccccaccctaactcacaatagtctctgtccctttataaggaaggaaccaccaccctcagaatagtctcccccttcttcagtgaggaactcccacacccgcagaatggtctcttccacacggaaggactccacatattcagaatggtttcggtggccttagccttcccaaaaagaattacccaccacactcacaatggtctctactctccatatgcggaaggatcccacaatcactctcagaatgttctcttccccgcccccaacacactgacaatgtgcacacacacacacacacacacgtcggtccacacgggatgctccctctcactttagtgaggaacattcccgactcccagcgatcccgacctccgcctcccatgcgactgctcgggcagactgtctcacccgcactggcggtccccggctccaatgcacccgcggaaaccgcccctggcccgggcgccgcggtggaaccaccagccccaaccgctgccatgttggcatctgcccggcccgtcccctcggcaacagaaaaaccacttccgcgttcgtcacttccgctgccgggccacctgagtgaaggtggagcgagagccgggatcgtcagggtggtggcttttctcctccgctcctaaaagctcaatgtatgaatagccccgggatttccaaattccgtcggatcgggaggccggggacacggcccgatcggcctacccaccatccctacagagcttcatcggcccattcctgtcactagacccgccttatcctgccgttcgtccgcttcactgatcgcgctttccagatcatcccccgatcttgtctcctagactcattggttcagccacccctttcatctcggctctttattggcagcttctccataaggcgccgccctttccgtatcagaaactaccaggtgcttcatggttggactgaaattccgctttcccgtcttccagcgaggcctcgccccctggagagcacacgggaatctggggacgaagaaactttgacctggcggggtcggggtgagggcgtactggcatcaggtgcgagtcaggaatgttaagctagcagataaaagcagagcaggtgaggataaacaagtgaaaatgcaaaggaaagttgacgcacataagggaagacaagtgagtcaccactgaggatggcaaaggggacaggcgaaaggctcacaggttagctagcatttggaagcagggcaagagtccgggccagaggcggtggctcacgcctgtaatcccagcactttgggaggctgagccgggcgatcacctgagctcaggagttccagcctgggcaaaacgacaaaaccccgtctcaaataaaaaaaaaaaattacccgggcttagtggtatgcacctgtacccagctactctggaggctgaggcaggagaaccgctggaacccggaaggcggagtttatactgaaccgagacaaataagcagggcaagagagggaacaactcaggtcggaacaagtgaaaccaacatggaatagggtaggccaggtaagtcaagtgttgaaggagaaattagagggatgggtatgtaagggtaaagatgggggaagaggctaaagataaagagcaaaacaggtgactacaccctggacagattccagtcagcgcccaaccccagccccgccctggccagtaccctgacagggcttttcttctgcaacaggggaaagggcttcttcattcccctggggtgccagggaaggtagtttttctgcttctgagatagccatcttgattggggatgtgccctaaacaccttcaatatgcacagtatctccaacagagaacccttctgcacatactgggcactgcataagatcaggggcaggggaatcaagatttttttgtgtgtgtgtggtgcagcttcaagaatccttaaagctctttaggatggcaacataagactgtggcttcctgaggacaaagcagagggacagtctgtctcagtgcacagtagatgctccataaaagcctcacacctacaaatggccagccgcttctgattctattacttttattaaatagtgggtttccacacatggctttttaaataatccaggcaggagaagagaggagggcacacttggaactcccctccccacaatacgtgattatttacattttagtaattggacaatcccggctcaggaggaggttgcaagaatctgcaaaagttggagggagcgccccaggagaacaaacagcaagccttatttcccctagcccatcccccaaaaaaccatccatcccatcctagtgtctggtggtgtccggtggtgtccatcttccattccttcccaaattatggaagtaaggttcttctcaccagaataagagcacttgggataacagagtagggtcccctcacccaaaaaaaaaaaaaaaaaaaagaagccttggggtaacaacagggcattacctcccccagaataaagaatcctgggctgaggcaggtaagcagcttgacccaatatgggaccctaggctaggggaaagggtccctttactaaaataaaagctactggggtattggaaggaaagcacccttgcccaagtaagagcatatgaactaagtttgtgtggtggtagtaggaggtgccaatgtggggtgacacatcatcagaataagagtcccggggctcagaatgggaacaacttcaccaaaataaacttccttagcaaaatgagaagcaagaagttccccctccagaatcagggaccacaggttctgggaggaaggctcctttgtaggattgggaagggaactgggcagacttggtttatgtcttctaacccctgatcctcaatcccttaccttagtaatactggactttaatgactggtaatgacctgtaaaaccaagtcaacaaatgtccatctatccctgtgacatggccatgggatggctcttctgaccattgggggccaggccaggccaggccaggcttagggtagcaaggaccaggccaaaggggcagggcctcctttggaggggttgaggggtacatcctcggctggtgtttgcatccaggggtccagcaggatctcttccagtgagggtcgggaagaaggtttgggggccaggcaccggcggattagggcacagcagtctgtaggccaagaagcagagagggaagattagcagtcagtagggggtactggtccctgagaaggatggagtcttctgggctggggtcagtgaggcctcacctggggagacatgggctgggaagtggagctcagcttccagaatctcctggtccctctcaaagggaatgtccccacacaccatgtcatagaggaggatgcccagtgaccagacagtggccgggagtgcatggtactggtgtcgagagatccactctggggggctgtacacccttgtccctgcacacaagccaggggttagaccaactcaatctcatgatgcccttctccaaccccaaactctccaggaaggatggcctcaccacaattaagagcactcaagataaaagcagagtcccctcactagataaaaagcagctaaaataacagagtcccctcaacagaataaaagcactgaaaagtaacaggatccccttaccagagaaagaatactcaggatggtaacaggatcccctcaccagaataggagcccagaataaggttagcacaccattaaaagatggactttatcagagggcaaggctgagaatccccagtattagcaatcgatcatcttatataatgcagtatgggtcaaggattacaggacaccccaccactggaggccaaaggtcacaaggccatcaagtaaaaacaatccctccagggagatttagagaagccttaccatcaaagtcagtgtagggttcatcatgaagcagggcaccagaaccaaaatcaatgagtttggcacagccacggcgtaggtctatcaggatgttctcatccttgatgtcacgatggacaactccacgggaatggcagtgctggatggctgccactacttggccaaagaagcagcggcttgggccttcacccagtgggcccttctctgtgatatagtcaaagagatcctgggcgggcaaaggccgctcgaggaccagcatgaagccctcctgtgtctcaaaccagtcaagcaggcggatcacgccagggtgcccaccacctgcacccactttccatagcagtgcgacttcgagtgggcatgtgactgagtctgactgggggcacaggtggggtgggaagcagggagagaaaaaagacagatgtcagggcaacagctctgaggctttttacctaagctcaactcagggccccttttcctgacagtgtgtcgctaagcaactcacttcccttcctgggcctcactttccctaaagacacaaactcacacagcgattgagagggtgaaaccagcaaagagcctgcacaaatctcgcatgtcgtagatcaataaacatttgaataaacgaaagaagttcggccaggcacagtggctcatccctgcaatcccagcactttgggaggctgatgtgggtggattgcttgagcccaagagttcaagatcagcctgggcaaaatggcacaaacacaaaaattagccaggcttggtggcatgcacctgtagtcccagctacttgggaggctcaggtgggagggtcgcttgagccaagaaggcagaggttgcagtgaagatcacaccactgcactccagctgtctcaaaacaaacaagcaaaaatacaaagaaaaatctggttatcaactgaaggctttcagcagaagcagcaccaccattatgtgttttgttttgttccctgacatatcccagattagaatagtaccttacacaggtgatcaataaatgttaaacagatgacagcacttaatagcatgggctctgacaagcagttagcactcaataaacacttattgtgtaatggtttgttttgttcacggacgtatatgaagcactagaacagtggctgctaacagagtagggctgaataaatatttgttaaacaggtgaaaacaattagtaaaaaaggacctagcacaaaatgagctctcaatacttatgtaatactttgctgagtgtctagaattatgtctgtcatatagtaggtggtcaatatacctaatttgttaaacagctgagtgatttattacaaaggacctagcacaaaaggacttagtgttatcatgtgttttgtcagcatcaccaagcacctagaaccagccaataaaaagcctaaatgtggccctgcgcagtggctcacgcctgtaatcccagcactttgggaggccgagacgggcagatcacctgaggtcgggagttcgagaccagcctgaccaacatggagaaaccccgtctctactaaaaatacaaaattagaggctgggcgcggtggctcacgcctgtaatcccagcactttgggaggcccaaggcgggcagatcactaggtcaggggttcgagaccagcctggccaacatggtgaaacacggtctctactaaaaacgtaaaacttagccgggcatggcagcgggtgcctgtaattccagctactcaggagcctgaggcaggagaatcgcttgaacccaggaggtggaggctgcagtgagctgagatcacgccactgcactccagcccaggcagcagagcgaaactccgtctcaaggaaaaaaaaaagtcataaatgcagccgggcgtggtggctcatgcctgtaatcccagcactttgagtggccgaggcaggcggatcacctgaggtcagcagttcaaaacccgcctggccaacatggtgaaaccctgtctctactaaaaatacaaaaattagccgggcatggttgtgcgctcctgtagtcccagctacttgggaggctgaggcaggagaatcacttgaacccaggagacggaggttgcagtgagccgagatcgcgtcacctcactccagcctgggcaacagagggagactgtgtctccaaaaaaaaaaaagtataaacgctgggggccacaaaatccgccccccactgcctccccaagccctgcgcaggtacacttcgagcagcaaccttctgggatgaggtagagccctctcctggccaggctgctgacttgcacggcagcagacgttttctcaccgagatgcaaaaataccgatattgcgcaggcgcaccctctccctttgggtcccatggactgcgcaggcgcagtttcccctagagcccgccagggggcgctcccaactctacaacttgcccagacccgccctgatgtccgttagcgttataacggcaagagagaagcagccaccatcaccatggcaaccagtgacctctgccccttgttccccaccagcacgccctgcgggcagtcccccagcagtgtttggaggaaggatggtaaaggtttgttggaggggagaatccagggctctaggggaattggggtgaatcagaactgtatgtcaccccaagggagtataaatggactggcagtattctcactgttacagggcccagggagtcatacatcccctggaaaagcaaggaggtgaatacatcagtgatggagtaggtaggttaggaagggctccgaaggtactcaccaagggggaccagcccagcacacgattccggggaatcactttgatggccacctggagaagaaggccgtgataaggaggccagcaggtgatccccagacccctcccagtctagaccttctgcctacctccagtattcctccatctaccagcactctagtctttctggtccccaaccacagcaccccacagaacgcgtaccagggcgtctcccctgccctccaggtcctcggaaccaagtttatctctcccaccttccttagccctgggctctccgttctcaggcatcaggactcatcactccaagtcctgagttctagatttcctgataccccaggcccacaatcttcctatttagctctacgacaccccaactctgtaccagggtcctggtccgcatgactccacactggacacctacctccaaaagtcccacaaatctcacatctaggtccctgctttcccacacatacacagcctggaccccggggtcaaggaactccggaatctgaagccccctgccccccccccccgcccataacctcctagaccgacacacacacgcgcacgcacacacacctggccctctacacacactgcaggctcactcctcggacacggacacggacacacacacacacacacctggtcctctacacactctgcaggctcactcctcggtcaaccagcattccagggccaggacccccgcccccgccacacgcacctgaccctcccaagaccctcatgacggatacctggagtcgatctgtgaggcggtgtcctgcgaagacggtgccaaagccccccttacccaggagggggccgagtcgatactcggcctcgaacgcttcccgatccttgcctcctacgcaggcggaggcgaggaagtcagggtggcggcgtgctgagcccagccacgactccctccccccgcgctgcaacccatcattccagcccaccccgtctggttgcagtaggggaggatgtactcacctggcggcggcgtgggggtcccggggggcgcgggaggcccctgtagaggcttggtcaacatggaggtggcgctgcgcagattgagcccactgaacccgctaagcccgcagggcgtggacgcccggggcagcgcagctggggagccagggctggggggcgccagggtggaaagcagagaaactggtggcccggaagcgcccgcagacggcgcagcgttgagattcgccgcgcgcgccagccccaatgctactgagcctgggcacgcgcctcccgggagagtcaccctgggcgacagccccgcccacctggctttgatcaatccggacgcggcacctgctgtaccacagccaatcggagccagttcttatttgcataccaccctcatcgtttcaagggcccccttatgcaaatacacgctcggttcttccgaggaggcggggcctgcatgtaaatgagggggcttgaggtggggctcacaccaagaggaaaccggttctgggaatccctttgcagcaccgcgcttgttttggttgttgcgcggggttgttgttggtagtggtggcggtgtgtgtgtgtatttacacttaaaaaataactgcgcagtatcctttcctgggaagttggtttgccgccgctgcctggatattagcacagagatagcgccaggccgggcttctaagaattcgcgcttgtggctatccaagactccgtctcgaaaggtgcttgtcggactccttcaccggagtcctccaggcgactggcggccttcactggaaagctgaggccagggccctggaaatatctggtagccagggagggggaacccctaccatcaacgccacgggtgtgcattggtcaaaggcagcattgcctggtgagtgtttattggagcttttaaccctgagccctgggcccagtcagcaagtctagaatctagaacagcagggggtggttcttgggggatgggggtgagcccagagtggtggtggcatggggctgctcttggagttgagagaggcaaggactgagagacatgatagaggctgctagagaagtggcaactctcagacacaaatttgtgaaaaacagccagaaaaggcgccacaccccaggaagaaaaatgcactccaaagacacatgaatgccaagatatacacaaacacatactgtcagacacattcacagaaacgacctagatacacatgcagccagagactgacatacactttcaggcaagcacactgtcagaaaaatagttatgtcctagaatgacacccagagatacactgttacagaaaggcactcacgcagacctacatttgccatgtgatgacacagaaatgtcccgtcacactggcagaacttgtcacaaacacactgtcaccatcagatatgcactgtcacagcaagacttgtactgtcccagaaatgagagacgcagagtctgtcacaggaagatgcacagatgctccagggacacacatgcactgctctgaaggcagacatgtactgatgtgatagaatcacattttgtggcagtgtcacaaaaacagacatggatagacctgttcagacacagacatacatacaccatgacacatgcagtttatcaatggaacaaactgtccagaaatagctacccagaatctgttgcaggaacacaaacggacatccaccccatcagacagaaaccacagatgcactgtcacagacagacccacgcaggcatgcacgcatcttggatttagacacaaactgtcagagataagagtcccacactcagtcaccatctgacacacctggaaacaagcccttcatcacacacacaactggggacactctgtgagctgcacatgaagacttggactcaccacagtcacacacacacagacaacaccaaaaaagcacacatgtactctcctttgttcacccaacgttattgggggtggtttgctataagcctgccaggccttgatggggatgttggtatcagagatgtacagataagtcaggcatcaaacccgtgccatgaagtttatctgtagtacagctactggggagatttttagatagaagtgagaatgtgaatgggcttctcagcaggtgaccctctgtcttgaaagacaaagaaggttggtggctcaggacaggggagggcaaattgcaggcaaaggccaagaacactggacagagcggcgagagattggcaggggccaaatggtgcagaaacttctacaaaaagaatactactaacatttgtgctctctcaatgtgccaagcactgtgcccaggtagtacgttactttgatcatacatattccctctagatgatcacagcagaagcatgagggagtagatatcactttttttttttttttttaagactgagtctcgctctgtcacccaggctggagtgtggtggcgcaatctcggctcactgcaacctccacctcctgggttcaagcgattctcatgcctcagccacccaagtagctgggattacaggcacgtacaaccatgaacggctaatttttgtatttttagtagagatggggtttctccatgttggccaggctggtctcgaactcctgatctcaggtgattcacccacctcagccttccaaagtgctgggattataggtgtgagtcactgcacccagcctaatcacctcttgtacagatgagacacttgaaacagagaagcaattgaccagggccaggaaggtttcaaagcaactctacaacaaatagatgcttggccactgggttccagacacactccgcagacagccactcagctagccatgccctcaactgcagaaccagacacacatcctgtcagagggtctccattatcatggcatggtgaaaaagctgcttgagaaaacctgggggccagccagccttctttaccttggatttacccctagggaggacaggcaaagaggtgtcagactgggggacaagaacaaaaaagggtttagccgtccttcaccttctaaaacctagtgggtgaggcccctctggttacttccactaaactcatgttgctacaaagtatcagttgcacttttccaaggcttttcttcatcagatcatgataaggaaagagcagcattcatggtgagaggcaggcggagaagctggaattcaggcaggaagttcaagctcacagtcctctgctaccatcacccccccccccccaggaaatagggtaggcaggggtggggtcagcaggcaaagacgcagcttttccagtggcaataggtccagaaggaggtttaataagcagcaaatcaaatacaaactccaggcccccagacagaccctgctggagagcattcacacctctgaggtcaagccaaggtccgtgccattgcatcctctgcccagaggcccgcccaacccctgccccacacagaacagagtcgctcagggaaactgacatttggttttattgtgccaaggacattacagatggcggatcttgtcaacacctgcagggcacgggtgccccatctgccaaggctgctcccacactccctacactcaaatcccgggtggcagccataatccccaaagatgacccccaccccaagattccaaagaagctagtggtggtggaagcaaaaggaatgcagcaaggtcagggtttcattgtccaagccggcctgacacctgccgccctgcccttgcccagtgcacaccctagaccctgggccggcctccatgcagctggaggccagaagacagcaacccatatctttgcaccctcctccatgccccatggcctgcctgcccagaaagatgccaccttcacagagccagtgctgtcgtctatatcatttttgattagttgattttataagataaaagtaattttaataaagaaaaaattcaacattgaaggctcagacgttcttgggggtactgggaagggaaatttcccacttcttcctcccacctccctggcatcagtgtcggggggtggcggcaagtttttctcatcttggaaggaatgaggggcagggagactttcctctgtctgaatgtctctctcctctggggctgcctggctgccagttggtctgtctctgtgtgcctcttgtctatcttcggcacccttgcccgagtcccctgtggaatgcagggatggttctgtgcgggatggggtggggggcaacagggcacatcagctggcagagagacaggtgatagtggcagcggcaatgagagagagtgcaggggtgggctagccagagggaagtgaggaggagggaaaagaggggagagcagaaagaacagaaggaggcaagagggaagaagccaaagaaggtgaggtggcaccggagagcaggagtactggggttgggagatggtgtccaatccctgggtctccatcaactcttgtctgggggcgggtctctgtgcactttgtttttcttcatactgtctaggtattcctgttgggacactgccagcaccgaagctaggatctcatcatcatcccagtcattcagacctgctgggcgagaggaagaggaaaaggatgatggagcgctctcagcctgccttctcctcaccctgtgccgacatctggggctctggagaaatcccatagggcccttctcactcctttctcaaaacagaaggatctgctaggcctgtgaaaccccacttagaccccagacccttctggggcaaattccttggatctgaaaaatcccctccagtgcctctcccttcttttcttggggagatggccagaggctccagaaagcccctctcaggacttgccacttcttccagtctctcccagctcctagcagcctccatccccccagacaaaggaggcttaccaaaggcagagggggacatctgctgaatgagggcccggcactccaaagcagggtagagggacacaaggggggaagttgcccggtcggcccctgccgagaactgactgcttgtacctgaagcagacggacagtcaaaggtagggacccaggatccaggacccaggacccaggacgtgcctcctaactcccagcacattccctgtgggcaagtcactgacctggcgcacagggcgaaggaggtttggcaagagctaaaacagtgcctggggaagggggcttcatgcccaattcagcatgcagctcagggtgctcaggtgacgaggctgaactccgctgccgcggggaccggctagtccactcctccaggccactggaggctgctgctgtggccgaactgcatgtggcgctggctttccggggctgcagcggggaaggtaaatgcgttaaggaccaccagcagccatgaccttcttgtgacccatccctgaatgctggctcccttcccaggaccttggctatgatacagcttctatgtaggtcaacatcatccccactcacacggtggaccacaagactcctcacaggacagaggtggagctccttaccctttctctcacacccctacagccaatctgacaggaaaccctgttacctctatcttgaaaatagatctcaaatccaaccccttctcaccaactccactgccagcactggccaccagtcacctggcctactgcagtagcctcctcctcactggcccctgcttctgccctcactcaccagactccactggatgactagcaggcaaggcgatcttattaaatccccaaccacatcctgtccgtcctctgctcacaatcctcccatggtttctgcctctctgagagtaaatgccaaagtcctcgccacagcccacaagcccctacccaattggacccacaacctctctgacttcatctactactacattctgttcggatacaccggcctccctctgggctgtgcctgagttgtaccaggtgtgtgggcctgctgtcctcccctccatgtgcgctcagctaactctcaccttctgcaaggctcaaatctcacctgctctgaggcctaccctgactgcgctatttcataccgtgaacgcacattcctgctcagcccctttatcctggctctacactttccatccatagcacttcccaactaatttattcattatatttattattttatttcactctgcaaaactgtgaacatcacaaggacggggatcttggtctgctgggctcacctatgtatccccatatactgaaaacagggcctgccacagactggtagtaggtatttgtggaataaaactcagctccttcagccgggtgcggtggctcacgcctgtaatcccagcactttgggaggccgaggtggtcggatcacgaggtcaggagatggagaccatcctggctaacacggtgaaaccccgtctctactaaaaatacaaaaaattagccaggcgtggtggtgggcgcctgtagtcctagttactccgcaggctgaggcaggagaatggcatcaacctgggaggcggagcttgcagtgagccgagactgcgccactgcactccagcctgggcgacagagcaagactctgtctccaaaaaaaaaaaaaaaaaaaactcagctcctgccagccaacatctacaatcactccaaactccttgcgattttacaattcctcagatgcttgtctgccccgcccctccccgctcccctaacaattcaaccttcctctgtgaagactaaccggagcccccacctccactgatctcccagtcagggtcaaggaccccaccattgagttgtctctgccaacagacgagatcgttgagggcagagtagtccagatctgatgttacattctcagtagagacctggcacacaagggcagtcaacaaaagcttgtgtctctgaagctatccattattctcgtgtcaccagcagcatggctgccctcctctcactccttaagtgcctgttctgcacaagtatttaaagttccaaggtacaatgccaaaactaagaccaagatgagttacagatggtgctggatgcttccttccctcccagatgtcaaaactgcttaatttttttctgctcgcttgagggcaaagcatgagaagtaatgagtttttggccaagcctgtgacagagtccatgacccacctggctggggcctcggacctggcgagcctgtttctcctgatcccgcaaccactgcaggtaggattcccgagccacctgctcctcgatggcttcatttgtggcctcccagtctgtggcccgtttcttgtcttctagcatctgctgttcaatccatgactcctccgatgtttttatggcattcttcatcagagactgctctgcaaactgcaaggagggagaggaacagggatgtgcaataacacactgaacctgcccaagagccagaacaggctcagcgaggtaggcccacaggccccagaaaaaaaaggagacaggaaagcaggtactcccaaagagcaacactccacagactacctcttgattggggaccaggggaaagcaggcttgggatgtgggacctgtcattccaaactcctatgcttgtaagacctgactctaacccccaaaccacctcaactgaggcactgagactggagcagtcaggtgccttccaacctgggacttattttttttttttttctgagacgaagtatcgctctgtcgcccaggctggagtgcagtggggtaatctcggctcactgcaacctccgcctcccaggttcaagggattctccagcctcagcctcccaagtagctgggattacaggtgagtgccaccacccccggctaacttttttgtatttttagtagaaatggggtttcaccatgttggccaggctggccttgaactcctgacctcaggtgatccacccgactcggcctcccaaagtgctgggattataggtgtgagccactgcacctggccctgggccttaatttaaagaagccccatccagtgatgactgtttcataatgttgaggactttcacacacatgagcagatgagacacatacaaaaattagctatgtgtgcaccgggtggagggagtattcaagcatgtgaggggttgggggaagtagtgggtgtgtgagggaataagggggcagtatcaacatggtgtggggtgctatgagttacaggacactacatcagagtactgtttttcaggctgagatccaacagcatttttaaaaaatagaaaatatcagaatatatcccagggaataagtgcaaatgttgtttcatgaagctttagttaacattattttaatgcacatatacacatcacacacaaatgcatatatgctaagtaatcatgtaaaatgtattcttttctttttcctgcagaccttgcattcagataaaatgtaattttttactgtgaatagttaaaaacaattcgtaaaactatgttagaacaagccaattaaaaaaatagtcaaaaaatctaaccactctggcagtgttaaacacactccaagtgttttttctactctcactcaacaacaatcaacacaggagacttctgtgaccaagtgtgcgggctggggggagggtgttttcccacacagcaagcagcggacacctggtgtccatcctccaatgcaattcaatacccagagacagcctgggatcccacaggttgagggctcagtcccacaagactccccccaacccccttcgaacaccagtcgaaagtctgggcctccagaatttctgactgaccagctataaattgggattcccacaatacttttttgggggttcaactaacttgctagagcagctcacaaaacccaggaaacacgtctgccagtttattatagagaaaattacaaaggatacagatgagatgcacagagtgagatatgggggaagggacgtggagcttccatgccctccctggggtgccaccctctagaaacttccatgtattcagctacccaaaagctcccagaacccaatccttttgggattctttggaagcttcattatgcaggcattattgattatgccattggacactagtgatcaacctaatcttcagcctctctcccctccccaaaggctgggggatgggcttaaagttgcaaacctctaatcctgccttggtctttcaggtcaccagcccccatcctgaagctacctagaggctgccagccatcagtcacctcattagcatacaaaaaggcaacactttgcagattctaaggattttaggaattgtatgtcaggaagtcacaaacacaattcaccaaagaagctatacagatggcaaataagcatatgaaaagatgctcaacagcatttgccaataggcaactgcaagttaaaataatgagataccactacacacctaagagaatggctaaaatccaacacaatgacagtatcaattgctggtaatgctgacaacaggaacttccaaatcattatggtgggcatgcaaataatacagccacttgggaagacagtttctcagttcctcataaatcaaaacataatcttacaacgcaatccagcaatcttgctcccaggtatgtatacaactgatctaaaaaattacgtccacaaaaaaacctgcatgcacattacagaagctttattcataatcatcaaaaactggaagcaaccaagaatgtcttttaataggtgaataattaaactggtacctccataaaaggaacattaagtgataagaaagaaaccagctaacaagccatgaaagaacatggagaaaccttaatgcatactgctaagtgaaaagaagcagtctgtcacattgaccattttaatttcaggggggaaaaaagcaaattggctgcaggtggctcacccctgcaataccagcactttgagaggccaaggcgggaggatcacttgtccccaggaatttgagattggcctgagcaacacagtgagatcctgtctctacaaaataaaaatatttttaaagttagccaggcatggtggtgtgtgcctgtggtcccagctacttgggaggctgaggtgggaggattgcttaaacccaggaggtaaaggctgcagtgatattgtgccactgcactccagcctgggcaacagtgatacactgtctcaaaaaaaaaaaaaaaaaaacagtatgaaaaggctacatactgtatgattacaattatatgacattctgaaaaaggcaacccacaaagacaatagtgtttgcaggaagagggaggaagggaggggtaagcatatggagtatgaggaattttaagggtggtcaaactattctgaataatactgtaatagtagatacatgacattacacatttgtcaaaacccatagaatgtacaacacaaagagtggaccttaatatatgctatttaaaaaaaaattaggaaggctgggcacggtggctcatgcctgtaattccagcactttgggaggccaaggtgggtggatctcctgaggtcaggagttccagaccagcctggccaatatggtgaaacctgtctctactaaaaatcaaaaaaattagctgggcgtggtggcgcgtgcctgtaatcccagctactcgggaggcagaggcaagagaatcacttgaaccacggaggctgaggttgcagtgagccgagatcgcaccactgtactccagcctgggtgacagagcaagactctgtctcaaaaaataaataaataaataaaataaaataaaataaaaattaggagatctatggccagcgcggtggctcatgcctgtaatcccagcactttgggaggccgaggcaggcagatcacctgaagtcaggagttcgagaccagcctgggcaacatgatgaaaccccgtctctactaaaaatacaaaaattagccaggtgtggtagtgcatgcctgtaattccagctactcgggaggctgaggcacgagaattgcttgaacccaggaggtagaggctgcggtgagttgagatcatcgcaccactgcactccagcctgggcgacagtgagactctgtctcaaaaataaataaataaaaaattaggagatctgagatcccagcatagaatgcaaaaatgtgacaaaataatacaaatgtattacaaacatgaaacaaccttggccgggcgcggtggctcacgcctgtaatcccagcactttgggaggccgaggcgggcggatcacgaggtcaggagattgagaccatcctggctaagacggtgaaaccccgtctcttactaaaaatacaaaaaattagccaggtgtggtggcaggcacctgtagtaccagcttctcgggaggctgaggcaggagaatggtgtgaacctgggaggtggagcttgctgtgagccgagatcacgccactgcactccagcctgggcgacagagcgagactctgtctcaaaaaataataataataaaataaaataaaaataaacaccctcatttgaagggggtgggggtacaagtaggtcactttcaaaatgaatggagtctgtaacaccaaaggcaaaaaagaactatatgtagcattgagctatagtgataaagttgtttcccacgggggtacgggtgaacaagtgtgattctgctacgcgtgtatatggaaatgagcagttacataaatggatggtaggaaccagtgcatatacatctgatggcgtatctactgttggagagggaatttgcagatgaacaaggggagaaggctagaatgaagcatgtgataatggatctgagttggagacatcagtaaggattcatgtttaatataaatacagatggttacaggtagaaatatttatagatatgtgtacaaaggccactatacatacatgtagctccttgctctatcagctgacagggcctagaagcatggacaacctgatatcgaagagcacattcaacacctaggtcttgatttctgttaacagtctccaatacatgccagggctctctaaagaaatggctgattgagctgggcgcagtagctcacacctgtaatccctgcactttgggagaccgaggagggtggatcacctgaggtcaggagttcgagacttcagcctgcccaacatggtgaaaccccatctctactaaacaatacaaaaaacagctgggtgtggtggcgcatgcctgtaatcccagctactcgggaggctgaggcaggagaatcgcttgaacctgggaggcagaggttgcagtgagctgagatggcgcccttacactccagcctgggcaacaagagcgaaactccctctcaaaaaaaaaaaaaagaccatattgatgtacgtaataactggaaaaattaataaattaaggatgagttaaggatgagacacagatcctccttaaagatttccaaataatctatgtagatactctaccctcaaggggatggggcataaccatttcttaggcgtgggctgcacatagtgacttccttccacacagtacagtatggaaaaggtgggaaagagtaaccttaggtggagaaacctaacaaacactacttctgccagttgatcaagggtaacaccaacaggcataaatgacactcatagtataaacccttgaaatgatgtaatgacaatggcactttacctctgtgatcttcctccctaagacccacaaccctagtttaaacatgagaaaaagtccaaaagagacatttcctacaaaatatttgatcagtactccttaaaactgtcaaggtcatcaaaacaaaactgagaaactatcaaagataaaggggcctaaggaggcatgcagatttcatttaatagtaacgtattaggctgggcatggtggctcacgcctgtaatcccagcactttgggaggccgaggcgggtggatcacctgaggtcaggagtttgagaccagcgtggccaacatggtgaaaccccgtctctactaaaaatagaaaaattagccaggtgtggtggtgggcacctgtaatcccagctacttgggaggctgaggcagaaaaatcgcttgaacccagaaggcggaggctgcagtgagccgagatcgcctcattgcactccagcctgggtaacagagagaaactctgccttaaaaaaaaaaaaaaaaaaagtattaatgttggttcgcacattgtaacaaatgtaccataatgatttgaactgttaataacagcagaactgggctgggcgcgttggctcacgcctgtaatcccagcattttgggaggccgagatgggtggatcacctgaggtcaggagttcgagaccagcctttgacatggtgaaaccccgtctctactaaaaacacaaaaattagctgggcgtggtggcgggtgcctgtaatcccagctactcgggaggctgaggcaagagaattgcttgaacccgggaggcagaggttgcagtgagccaagattgcgccattgcactccagcctgggtgatgagagagaaacttcgtctcaaaaaaaagatgataataataataataataataataataataataataatagcagaactgtgtttgggaagagaaggatatgtgggaattctgtattatctcctcaattgttctgtaaatctaaaactgctctaaacaattaagtctattaaatacaaaaacttaaaacattcatttttattttttctttcagacagagtctcgctccgtcacccaggctgcagtgcaggggtcaaatctcagctcactgcaacctctgcctcctaggttcaagtgattctcctgcctcggcctcccaagtagctcggattacaggtgtgtgccaccacacccggctaatttttttttgtatttttagtagaaacagggtttcatcatgttggccaggctggtctcgaactcctgacctcaggagatcctcccatctcagcctcccagtgttgggattacaggcgtgagccaccgcacctggccagaacattcatatttttgaagaaagaaaaagaggaagctgggtgcagtggctcatgcctgtaattccagcactttgggaggccgaggcacaaggatcacttgagcccaagagttcaaggtcagcctcggcaatatagtgagaccttgtctctacaaaaaaaaaaaattttttttcatttttttacaaaaagtttttttaaaacactggccgggcatggtggcgagcacctgtagtctcccagctactcgggaggctgaggtgagaggcttgcttgagccagggaagtggaggctagctacagtgagcctagattgccccactgcactccagcctgggtgagagagtgagaccctgtctctccacccgcccaccaaaaaagaaaatgagccattaaaccaggacaagtcacagatgaatcttaaatgcatagtgttaagtgaaaaaagccagtctgaaaaagctacatactgtacatttccaattatatgacattctagaaaaggcaaaacgagagtcagtaaacagatcgaatacaaaaaacaagaaaattctgagaaactgtcacagccaagaggagataaaggggacacaacaactaaatataatatggcaccctggatgggatcctggaacagataaaggtcattagggaaaaactaaggtaatttgagtcaagtatggtctttagttaataatatgtcgatattggctcattaactatgacaaatgtactatgttaatacattaatcatagcgaggcatatgggaactctgtaatatatttgtaacttttttttttttttttgagacagagtctcattctgtcgcccaagctggagtgcagtggcacaatcttggctcactgcaacctctgcctcccagtttcaagtgattctcctgcctcagcctcccaagagtagttgggattacaggcacccactgccacacccagctaatttttgtatttttagtagagacagggtttcaccatgttagccaggctggtcttgaacccctgacctcaggtgatctgccagcctcggcttcccaaaatgctgggattacaggtgtgggccaccgtgcccagcctctttgcagtaattctgtaaatctaaacctgctctaaaattaagtttatttaaaaacaaaacaaaaaagaaccctatgttggagggtgtgttggtgttaggctatgtgtttccgaaaatgaagcaggagtactttgtgtttgtagaagtgaaacctgaatagaagataccaaaatcctcagcaaatgactgtaagagagagagagagaaatgaatgagaatctatcggtatgtgctgggaaaatgcactgccaccttctgaacacctactaggccccaggcccagtgggaggtgctttctgtatcagccaagctgccagcctggaatacttacagaatctgcctagatcacacagccagtgagtggtggggccaggcctgtaccccatgtctctgtgaccatggctgtctgtaaccactatgatcccaggagaaagatccatgccaagatgcccagagcaagccctggctcactgctccaaaataggactccacatcctaaaatgccagccctcaacgggcacaaaagataggtaagccaactcagacaggcaaaccaagaccaaagaacaagccctgagagatcaccttaagtaactccctattttttttttttttttttgtaagggtgagacctcaggggagagaggagacaggatatttttgtgagttaggggcaaaacagactccaacagaggtttctgacctctatatccagcagccattctgggcacagggacccactcacccctggtttgaatgatggcaggcccagccccacaccaatggtggccttgttaggattcaccactgaattatagtggatattccgatggtagctaacacgaatgggttcgtcctcgttttgatgtatcccatggaatgtgttgatgggttctgcagagaaagagaaggagggagcatccacagcaggccaggttgggcaggctcgaatgaggcaccatctttccctcacctacccactgcagaagtacctgtgctgtactggtacacctccacaggacggttgtacatctctgccatggcctgcatctcaatgtggttgccatggcaattgtttttccgcttcctgttaatgtaggtggtaaagtcctctgtgacatagttggagaagtagtcggcattcttcatctgcagaatagattggaaggttaaggtctgtgtggagaagaaatcctcccaccctgccccttccccaaaggcctccattttctcaccagatagtccatgcaatgctttcgcacaacctcatgcatgtcctggtctccatacacctggtcagctgtgggggcagaagaaagcagcagctagggtcagagatgccagagaagagctctgaatcatagaacatcctttggggaggaggaactgggggaccagggaaattcccttttctaccccaaggcctggagagttcttgcccttgtaggctagaacggggtcatggaaaaatatggcaggcagggccagacttgaagaacaagagagtgcaggtgagaggaacacatccacaggcctcttgggcagatgactttgtctagggtacacgtggccactcagagaaatcaacaacattctaagttccacaggttggcctcaaatgctattgattcccacaccccctttgctttccacatgaggaaactgaggttcagggggagtttgtggtttgtccaaggtcacaaagagtcagtctgtgacagagtcaactctgaattcagttttcctgactcctacaagtcaacatggcctttgtaggctgaaaaaaaagggaacaaagacaaaaaaaggaaagaaaaaaaaatgggctccaagcccagttctgccagatactagagagttgagtgaccagaggcaagtgacccaagtgttctgagcctcatatacctcatctgtaaaatgggaaaaagagggataacaggccaggcgtggaggctcacacctgttatcccagcactttgggaggccaaggtgggcagatcacttgaggtcacgagttcgagaccagcctggccaacgtggtaaaaccccgtctctaccaaaaatacaaaaattagccgggcatggtggcgggcgcctataatcccagctacttgggaggctgaagcaggagaatcgcttgaacccaggaggcagaggttgcagtgagccgagatcatgccactgcactccagcctgggcgacagagtaagactctgtctcaaaaaaaaaaaaaaaaaaaaagggataaccaaatggcaggccttttgtggggattaaatgagataacgggtataaaataactaccactgggcttgggacagagtagccacagagtaaatcagaattccttcctccgtagggaggcctgaatgtggggtactgtgaaggtgacagaggtgagtaaaatcctgcccctaccttcggggagcacacagtctagtaaaagagataagacacacatgcaactaactttagcttaactcaggatgggcagcctgtggcccgaatagtccaggcgtcgtgagatttggtcaaactaaggcgagaaggaaacacactccctctgcttcgcttgaggatcttcacacatgccgttccttctcttcaggacgctccttccatcctcgtcagctgcctacttctcaaacaccaatgtgttctttatttatttatttatttgagacaaggtctcgctctgtcgcccaggctggagtgcagtggcgcgatcatagttcactgcagccttgacctcctgggctcaagcgatcctctcgcctcagactcccaaagtgcctggattacaggtgtgagccaccgcgcctggcccaacatgttctttaatacagttccccactacccaggacacctctatcaccagatttatcaaaggtgtgcatagacttctgcccgaccacactgggctcccacagaaggcaaagggcagttcacaccaaagtccacccccagctcagggcccgatacagtaaaggaaatcaggaaaagtttactgagcaaatggataggctgggtaagccagggagctcttctccctgtgaaattaaagtgggcctgaagatcatgcaagtctgatttccactggttttgggaatttccctttgtttccccagaggaccactgctctgatgggatctccctggggcatggggctagggtcaggtcacacaggaacactcctgagttcttccctgtcagtctacctctctgaagaactgtcagaagaacaccttccctgccttccccttcctaccctggagtgttctgtgagaaaggctactctgagatagaaaatagggcccatgtttgtctccagtcctcttggaggtgaagagacctgaagggtaagggggtgtggaggttgtgaaggcgggaaggggggtagccccttcaccaatgtaaacaaggatgtgggttctgcggccacactctcccccgccctccccagcggcatttccagcaagtcacatgtcctgcgcacaggctgggggccccctgctgctgcctttcttagaagccaggaccacagagcccgcacagtgagctacttggggagctatttctgtagactgagcttggggtactgggaggcagtgctgttggcagctgcagtaaacaggaacaaagatgagaatgaaggggttaaataggggttggctggccaggctcagagagataggctgaggtgctggagaaagcccatctcctatggaaaggtcaacggtcatttccaggcctgggagttctatcttcaagagctagatgccagatgcaggaaaatggggaaagagaggagactgtggaacagggaagggatctgggggaaaaccccctgagggtcccatttctctgccactgacccctttgcctggcagaaaggctctgctgcctcctagctgtgtagcaatggataaggcctttaacctctctaagctgaaatgtcctcatgcataaggtggagacagtaactcctcttccatctgctgggtgttgtcaaaactacacaggaggtttgccaagcacctaaggcacagtaggtggtcaagaaacaggaacacaatttgtcatgacgacaatgattccttcatatgctagttacccacgagtcagccagaatgttgccataaccacttatgaagcccttcctcatttctgttgcaattcctcagccagaggaaagccccaaatgcagacctaggatgcatgtcctctcctggctctctacctttagcgaaaccaaaggtccacaagtctacctctaggccgttagttctaacaaaacttcagcagttaaattaatatcgaattaacaatacaggcttcataaaacagggtcctaaagtatggacgagttatgacacttctttacttatctgtaaaatgtaaaataccaccttctctcctcaatcctatgatggcactgataggtgatatggtataacatgtacctaatcacagcttttgaggggggaaacacaccacactgattataaggtataccctaagtttggaatcattaacgtggaagaaaatatacatctccaaaccaaggaaaacagcaatagtactatcccaacaagggagaatagaaggatttctccaataatataaggcaggaaaagcatctaagcacagagctaaacacataggaagtactcaacaagaattcatttttggccaggtgtggtggctcacgcctgtaatcccagcaatttgggaggccgacgcaggtggatcacctgaggtcaggagttcaagaccagccgagccaacatggtgaaaccctatctctactaaaaatacaaaaaattagccaggcggggtggtggatgcctgtaatcccagctatttgggaggctgaggcagaaaaatcgcttgaacccgggaggtggaggttgcaatgagccaagatcacaccactgcactacagcctaggcaacaagagcgaaactctgtctcaaaaaaaaaaaaaagaattcgtttttctgactttcctagctccacctctgtcctccagaaagccctcctcttcccagaaggctggcacacagggctgggggccaggcttgacttccctgtggaggggtctgaggttggggggatgacctgcagaggtaggggaattcagagaacttgttttgatagaaactgaaactcctcctcttgctgacgctgcacttgtgggcaatctgcacctgttctcccctcccagaggccagctggaagggggtcccccaccattctacctctgttcccatctcaaacagggctcagaaatcctcagtacaatactacaattggtcccacaccaaagacttttcacactccaactcattctatccttaccaaaacactcttactttacccaggagacacagaaatgtggcaaagcttgcctgggatcacagatttagggggagtgaaggggaggccaggctctcaaagggtaactgctggccccagctgatattaccaccttcaccccaatccagccaccatcttagtcaccttactccctggggcaggacctgatcttgtgtgcctcagtttccacaccagcacaagcaggaatcagctagaacccaggaaaggcatgggagagggcagagattatagatatcaggggctgcatctctccctagggccacagaggccaatatgaaccttaccctccccatacacaccccacttctttcctttttctggacacacagagacaccagtatagaaatgcacatgtgtatacacatacagcagagactgccaaagatgctccctgaggccaaatgctcacccaacaaatcccacaacagagaactatcacattcaatgagtagatgcccttgccacttcaggaaagactgaagatgtgaggctctataaactgagggaccccctaccccaccaacctccttcctggcctctggcagggtaggtggagggcaggggaaataaccaagagctctaacagactagcctcaacctctctcctctgttgcccgggggaagtccttatgtaactaatgtaatgtaaccaataatgtacccagatttatgttaagaagcaagacatgagagcctggattatcttcctatagggtcctaccatttgctttagagacatctgagaactgcctactccccaggtagctgcctgcctcccagaagagccacagcaagttccgctaagggcaaaaaaggaagctaggtgtctacagggaacctaaaaacaaaccacactaacgtgtgtacacacagctgcagagggagacagggacctggtctgctccccactaccctcctggtccagtgggaaccctggccccactgagaaccaatctcctgaggagatgagccaggacaaaggtctcacttgcctgtcaagcagctgtggtgtgacctggtctgtagccccaactaccccaactagcataccctcagtgggagagacagaactcatcccactggatagtctggttcctgagatgtgtgctcctctgctcaaggattcccactgcaaggatgagaaacctgaaggatacacgggagaggctgaaggaagctggtgtacaggaaatggcccgtgggaatcttctttctgtggcctggttcaacctcaaataccaatgttctgacactggttgtatgacctagatagggtagggtcttggctttctcttgaggcctcagtttccccatttataaaacaatcaaaattgatctcagatccatccctcctagtgctgatgttccaagaccaaaaggcccagaagagtgggcctagctaatgtttctgggcctcatcgtggtaacatgcacagcccttgccactcccccatggcccatgtagaaacaaccatgtggccttcactctgcccacagaagctagcaccaggaccctggtcagggttagaggtttctgctgagtcaaagccacatggagggagggagcaagggagagatgcagagtcatgtttccaggaggaggttatctgagcataacagggacagggtgggccacaggatacctctgaggctcaggttcccacctccactccacccaagccttcaatgatgctcatgaatccccaataagaggaggtgggagagaactgagcgcaagcaatggatattgcttaactcaggggaaccaatggcaggcaggcagctacctggggagtaggcaattctcagaagtctctaaagcaaatggtaggaccctataggaagataatccaggggaacagaaggcagaaagccacctgcctcaagactcccaacaacagagggccacgtgctcctacttggaggaggtaaggtccagagaagtcaaggaacacagccaaggtcatccagccagttgacaaccaagctaagaagctaaggatcctaggatcataaaaagaatgtgtcctggccggatgcggtggctcatgcctataatcccaacactttgggaggccaaagcgggtggatcacaaagtcaggagtttgagaccagcctgaccaacatggtgaaaccccatctctgctaaaaacacaaaaattaaccaggtgtggtggtgcacgcctgtaatcctagctactcaggaggctgaggcagaagaatcacttgaacccgggaggcagaggttgcagtgagccgagatcacgccactgcacattccagcctgggcgacagagggagactccatctcaaaaaaaaaaaaaaaaaaaaaaaagaatgcgtgtcctttggacacctctgggttcccaggccagctctggctaatggccctgagcatgtcatttccctttctatgcttcaatcttttcacctgtctcatgggataatgatccaagttttgcagtgagcctgaagcacccagctgaatgcctagcacacagcaggggtcaaggaaacagtgccctctatgtttgcagcccccgcccaactccaactctctgctccacgttccttccactattcaacacatggcaggaagtcagcctgtagggcttcacactacagtctaagctgactgccatctgtccccatccaggcgaggctggaaacgggggcagcaaaaagcccagggacaaagtccccttcccaggcacatgtattatgcactctgcaccaaggaaacctccagataaggtctagagaccaagggccatgtacttcgggggagaggccagaggacttctgaggttttacagagaaaagccaaaggcagcccagtcaggggaaatgtgtagccatagtgccgataaggaaaggccttcaacctgccctggtcagctcttcctgtaagtagaggccccttaccgaaggccccagtgggaggaagggtcgggagtatttggggagaacagctagatacatatagacacacacacacacacaaatactgctcttgatacgagttactacaacaagccaggtcctcactagctagccccaagggtcgggggtatttggggagaacagctagctagatacacacacacatacacacacacacacacacacacacacacacacacacacacagagaacagctagctagatacacacacacacacacacacacacacacacacacacacggctcttgatatgagttactacacaagccaggtcctcactagccagtcccaaggcttaccctcaatgactgcccaagactcagatgcccgctgcattctctaatcctaactccaccagaagccctgcttaccccacatctagcctgaggtctcaacacagggcctagcacctaacaggcccccacctattctttctttgcctttcttttgtccaagatgccccgaaacccagctcttcctctgggaaacatcccagggaaaacacaaacttgagccagaggggtaggagggataagttttttcccagtccaatagagcccattgcctgagcctcttctgcttggcagaatagagaggagaccattcactccaccctttcaacaaacacatgtgactctgaggcaccagtgaaaatggcatctgggttttacaaatgctactgttccatgagggtctactatatgtgtcaggcactaaagggatttaccaaagcaacttcattaaatcgttacagcattagggtcttttagccccattttacagatgaggaaacagcctcaggaaagaagagctgcttgcctaaggtcataccaagaatcagttgtgcagccagggatggagcctaaaacaccccagcccaccagtagacatggggggtacccacagacggagagaatagcagaccaagaaggaactcaaagaggcattgagaatcaacaccatttcacagacgggaagaccaaggccaagtgtcacagcagttatgagtcagggccagaactagaaggtaggtcttctgactcccagctcaaagctcctatcagagggcacttttccttggtagatatcagagaaccacagggaggatcaggtcacattcccagcttccccttcaccctagcacaggacctcacaactacttgttgggtcacagattcagagccaaaatggcctcaaagatctaactcagactggataacagatggtattaaggcattattaattctgttaggtgcagtaatggcattttgattatgttaaaaagaagagagtaagtctgtatctgtcagagaaacatacagaaatatttatgaatgaaatgatccaatgtcggggttttgctttaaaaatactcttctttcaggggagtgagaaagagtgggcgggatagtgatgaaacaaggctggccacgtattgactattttgaagctggatgatgggtacatgagggttcatcattctctctacttttatataagttgaaaaaaaattctatgatataagaaatttgtaaagatctagtctgatagcccccatacacacagattgaggaacagagacccgcaacacaccagagatgggatctgggtataaacctaggggtcatacagcccagggtggcagcagtgtgctatggttaagagcatgggcctcagactaatctaacccagacactgaatcccaactctaccacttattatttcactccagacaagtcacccaccatctctgagccacttttctcatctgacaaatggaagcaacagtagtccctacactcacctagcttagaggggaatcaaagaggtttcctgtagcacctgacaatgtgtcccaaaggatattattttctttatcattcttcttgctgttattatgcatattaatcttgcaccactacaatgtctcaagacccacggctagaggtcagataccaacttgaggctggagcctagagtccctaaaagattagctagctctgcctcaaccctgtctcaggggctattcctgataactgggacacagcttaggggcagccctaggcccttaaggactaaggcagagactcacctacagcccggaagagacaggcgccatcctccttcatctgcttgatgatgaagcccttcttgtctcgtagggccttttcaaaccaatgctcctgctggagggaagaggtgggggtcagcaacagggaaaacctgtactccctccccagggccccgacctcaagctcccgagaggcctagatcattgacagagaggacgctggccaaggtaaagttctcagccctgtttgaccactccatgcatgtgaagtaggagactcttttagggaattagttgctgagtgaaactaagacttacttccaaaagggtcctaggtgccctgagaacagtggccccatatgccttatggcttctgttgaccttgcagggcctggcccagggagccacactgcctcaggcagccagagactcagacccagcaagtgcctgggtggagaatgtggctctacctcaaggagtttcatctaggaaaggtggtgaagagggggtaactagcaagagcctagatcctgaacctgacaaagggctagaggattccaagatatgctgtaggccgggcatggtggctcacacctgtaatcccagcactttgggaggccaaggtgggtggatcacctgaggtcgggagttcgagaccagcctgaccaacatggagaaaccccgtctctaataaaaatacaaaagtagtcaggcgtggtggtgcatgcctgtaatcccagctacatgggaggcttaggcaggagaatcgttcgaacccaggaggtaagaggttgcggtgagctaagatcaccccattgcgttccagcctgggcaacaagagcgaaactctgtctcaaaaaaaaaaaaaagagatatactctagaaggcaaaagtgtgcaaacaatgttctcatctgtgactgaacacatttaacagatatctacacatatatacatatgtatgtatacaaacacacgtacacaaaattgggaaggctagacagcaaaatatccctaagtcctggtgttatcagcgattttattgcactttcccttttataaagttacactaaacccaaaaagctttgaaaatcaagtctttttttttttttttttttttgagatgcagtctcactcttttgcccaggccggagtgcagtggcactatctcggctcactgcaagctctgcctcccgggttcatgccattctcctgcctcagcctcccgactagctgggactacaggcgcctgccaccatgcctggctaattttttgtatttttagtagagacggggtttcaccatgttagccaggatggtctcgatctcctgatctcgtgatccacccgcctcggcctcccaaagtgctgggattacagacatgagccactgtgcccggcccaaaagtctttatctaattcatttggcatcataacctgaccagaactgacaagaatctatttatcccacttggggtaaatattcaaatatttcaatgcagaaaacattcaggtgtttgattatgaggtgctgcctcagaccctgctggaggtgttatgtaacacaaagtatacacaccaggtaagttttataaattgtttttttcctaaattccaaagcacacctggcaccacgaaggttcaacttaaatgaacctgtacaaatgcatatttttttattaaaaaaataatgaccatataacctcttaaaacataattttcatttcaaaacaaaaccaaccagaagcagcagacctttcctgggcccctcacgccctctgctggctaccagaagcagccagcctgacctagcaacaaggctgcaaactacaggatcccaagcctgctccttgtggacacaggcctgcccagggatttataggatctggggtattagagaccagacataggggcccacctatccgtaaggccatttttccccagctcaagcaaggggtggaacccatcccctaagaaagccagaggagaagcatctctggcaaagttgtaagcacaaggtttggaacgcaagagctctgggttccaaccccagctttgccacacacttgctgtctgttatcactctcagtttcctatagaatgggggatatgttgatctaccggacagagctgtgaggagtttcaggacctaaagaagctttgtaaataacgtaccatatactaggggaagttgtcgccaatcacagaaggggaggagatcagcacagagattatgcacaactgagagaccctcagaaagtcctaggtgagtagcgggacaggaggggaggaagaggtgacaagggaatacccagccagtcccatcatcagggcccacaccccaggaaaatgtggctggatttctagagatgacaaagacacctggaagcccttaatgagcttccatgcgcagcacaaggactcctgtttgtgcacaacattccagtagtccaggtgtccctccttgcccccaagcctgtggattaacacactccagccagttatgcccaagtccatcctggccacacatggtcagccatctcccagagtcatgggcctgccccagccaggggtctccagcagggatggtgcaaccacaactatagtcccaaacctgacacaagaataggttcttaaaaagaagggaacacagcgacttcctggctttggagagaggggaaaaagagaggagaaaaggagatcaaacaggagaggggctcctacttatccattcaagaaagacttaccaggtagctactaagtaagatactgggctgggcagtgaggacagtgaaatgaatcagacttagtctccactcttgataagctcacaaactacttagcagaggggtagggaaacaggtaaccaccacaaggtatgaacaaggctgtgaaaaatgtaaatgccaggtgttgtgaaacagaaagaggctgggcgaagtggctctcgcctgtaatcccagcactttgggaggccgaggcaggtggatcacttgagatcaagagttcaagaccagcctggccaacatggtaaaaccttgtttctactaaaaaatacaaaaaaaaattaactgggcatggtggtgcatgcctgtaatcccagctaaatcaggaggctgagggagaagaatcgcttgaacctgggagacagaagttgcagtgagccgggatcataccactgtattctagcctaggcgacagagtgagactctgtctcaaaaaaaagaagaaaagaaaagaaacacagtcattgggccaggcacggtggttcacacctgtaatcccagaactttgggaggctgaggtgggcggatcacctgaggtcgggagtttgagaccagcctgaccaacatggagaaaccccgtctctactgaaaaatacaaaattagccaggtgtggtggtgcatgcctgtaatcccagctactcgggaggctgaggcaggagaatcgcttgaacccgggaggcggaggttgtggtgagccaagatcgcaccattgcactccagcctgggcaataagagcaaaactctgtctcaaggaaaaaaaaaaaaaagaaaaaaagaaacacagtcattaaggctagcacctgagaggaggtgccacctgaccaaaggattaaaacaccaagacctccaaaaatgcttgttaactggatgagaaatgaagtcacttctgccacgaagtaccaggaatgcctggagcccagcaatgaattcagtagagctaaagttctgggtagtactaggcaggtaagcagggaggaccaggaagaaagatgaactcatattaactgaatacctgccccatgccagatgcaaagggtgacctcgtttaattttcctgaccacagcccaggtggcaggaaacattaccctcactttacaaaggcagaaaggaggccagacacggtggctcacgcctgtaatcccagcactttgggaggccaaggcggaaggatcatctgaggttaggagtttaagaccagcctggccgacatggcgaagccttgtctctactgaaaatacaaaaaattagcagggcgtggtggcgtgtgcctgtaatcccagttacttgggaggctgagacaggagaatcgcttgaactcgggaggtggaggttgcagtgagccgagatggcaccattgcaccccagccagcctgggcaacagagcaagactatgtctcaaaaacaaaaacaaaaacaaaacaaaaaacaaaaaaacaaaggcagaaagagaaaggagctggagtttggataccagcaaagcctagtgtagaggcaacagggaaggcccccacgagccacagcatggaggacataccttgcagcccatccacagaatatcctggtttgtctctaaacatgaaagagacctgaataggcccctcgcactgcagggtttgggtcctggggcagtcaaactggcatccaggcttggatctagaggctggactgctagccacccactggctttgtcatcagcagcctgaggagtttgggctctggcccttctctttctccttttggggagaaaatgttgctcaggaagggctagtaggggtggggggtaggggatagctcagccatagataagtttaagctccaacaatgccctggcctgaggagattgtgaaccttgcaaactcatcgctgagcctatgggaaaatccctccatatctttgagcctccacaaaaaggctgagtaaagctccctaacaccagaggatcccaggagctgaggcaagattctgtaacctagtggtctaagggcccaagtgaagttggagcaggctgtggaacccaactgacttaggttccaatctagctccaccaattattagccatgtgatgatgaactgctctgagccacagttttccaatctgtgaatggggataccaagcctcccaataatagggatgctgggcagactcaaatattacagggctttgcccagtaagagaccacttaatgagttcccttcccttccccaggagggaaaaaagcctctctagtaggctgattaatagccacgcaaagatatcaaaccctaacccccctggaacttgtaaatgttaccttataatgaaaaaggtagggccaggcgtcgtggctcatgcctgcaatcccagcactttgggaggctaaggcaggcagattgctttgagctcaagagttcaagactagcctgggcaacatggtgaaatctcatctctacaaaaaatacaggccaggtacggtgattcacgcctgtaatcgcggcactctgggaggccgaggcgggtggatcacctgaggtcaggagttcgagaccagcctggccaacatggtgaaaccctatctctactaaaaatacaaaaattagctggtcatggtagcaggcgcctgtaatcccaactactcaggaggctgaggcaggagaatcgctggaacctgggaggcgaaggttgcagtgagccgagatagcaccactgcactccagcctgggtgacacagcgagactccatctcaaaaacaaataaataaacaccaaaaattaaccgggcatggtggctcgcacctgtggtcccagctactcaggaggctgaggctggaggatcacttgagtccaggaagtggagggtgcagtgagccaagattacgccactgcactccagcctgggtgacagaggccagcactgtctgaaaagaaaagaaaagcccgggcacagtggctcatgcctgtaatcccagcactttgggaggccgaggcgggtggatcaactaaggtcaggagtttgaaaccagcctggccaacatggcaaaaccccatctctactaaaaatacaaaaattagccaggtgtggtggtgggcgcctgcaatcccagctactcaggagggtgaggcaggagaatagcttgaacccaggaggcggaggttgcggtgagccgagactgcgcctgggtgacagagtgagattccacctcaaaaaaaaaaaaaaaaagagaagagaaaagaaaaaaagtgtttgcagatgtaattaacttacattattaaatctggagatggggggttatcttagagtatcaggtaggacctaaatgcaatcacaagtgtccttataaaagagagacagagggaaatttgatacagacagaaaaggaaaccacatatacagagaaggcgatggtgaagatggaggcagagattagaatgatgcagtcataaaccaaggaatgttggcagccacgagaggctagagaaggtctaaattctccctgagagcttccagaaggagtgtggccctgccaacactttgatttggatgcagtgaaactgattgtggacttctggcctccagaattgtgacagaataaacttctctctctctttttttttttttttttttttttgagatggagtctcgctctgtcacccaggctggagtgcagtggcgcaatctcagcttactgcaacccccacctcactgcaacctccaatccgtctcctgggttcaagcaattctctgcctcagcctcccgagtagctgggattacaggcacccaccaccacacccagctaatttttatatttttagtagagatggggttttactatcttggccaggctggtcttgaactcctgacctcgtgatccacccgcctcggcctcccaaagtgctgggattacaggggtgagccaccgcacccggccaacttctgttgttttaaaccacccagtctgtggtaacatttgtcacaacagccacaggaaactaacacaccccccttggtagcactccttggtgtctgttccctagtgcctcacaggtgtgagacaatatggcatggatcccgctctgcaaggtccacctgcctaccatcctccagggtgggaggttagaattaaggcagcaggggcctggaatctcccttctcaccctgggaaactactgaccctgcctatggatggatgagctgccactgaagtgggggtggggtgggggggcaaaagatggcagcagcagtggcagttcatggacagatgtcttcccagagcctatggtcaaaaggtgtttagcattctgtgactcacagctctgtcccagcagccctggtgccaagaccaccccctccagcaaagcacccaggaacactagcctggctccatggacaaaacacagggggccaggcgtggtggctcacgcctgtaatcccagcactttgggaggccgaggtgggcggatcacgaagtcaggagatcgagatcatcctggctaacacagtgaatccctgtctctactaaaaatacaaaaatattagccagacgaggtggcaggcacctgtagttccagctactcgggaggctgaggcaggagaatggtgtgaacctgggaggtggaggttgcagtgagccaagatcgcgccactacactccagcctgggggacagagtgagactccatctcaaaaaaaaacacacacaggcaacccatccaacgaggaacatagacacactactctctaaggaccaacacaagccctccagggcagaaggggagaagagcaaggccccaacatttggctaggccactgagggcagggggattaaaaacctctaagattggcagggtgcggtgactcacacctgtaatcccagcactttgggaggccaaggcaggcagatcacctgaggtcaggagttcaggagaccagctttgccaacatggtgaaaccccatctctactaaatatacaaaaattagccgggtgtggtggcagatgcctgtagccccagctacttgggaggctgaggcaggagaatcacttgaacccggaagccggaggttgcagcgacctgagattgcgccactgcactccagcctgggcagcagagcaagactccgccttaaaaaaaaaacaaaaacaaaaacaaaaaccaaaaaacaaaaaaacccaaggtcctgttattcagtaatagaaaggaatgaagcactgatgtatgctacaacatggataagccttgaacatattatgctaagtgaaaaaagccaagtaacaaacaactgcatattctattattccatttacatgaaacatccagaacagacaaatcaatcaagccagaaagtagattagtggttgccagaggctggaaagggatgaggaaattgggggatcatagctaaagagtgctggatttctctttaaggtgatgaaaatgttctaaaatggactgtagtgatgtgatggacgcacaaatctgtgaatatactaaaagccactgaactgtacacttcaaagaggtgaatagtatggtacatgaattacatctcattaaagttgttaaaagaaacacacccaagggctcagcaccagccaaggacgctgaacactgcttgaaatgtcctagcacaatccccaaaggccaaggggtcccacttaaaactttcatgaagggtgaggggagtgggagcagggaggagactataacttgcttcagagcaatgagtccaacctccctcctcaacactacccatttcatggagggagaaaccaagaaccagaaaagagaactgcctgaagaccacagaaaagcttactgcagaaacaggactcaaatccacgttgcctgggcagagaccccttcctgcttccccaccagctagctacccaattccagttggggtaagaagagcccaagaaatcagcaggttcctagatgccaaatgaagggcctttgctatcaaagataggttactaggagtggacaaaggctcctaggaagaaccaagatgaccctggggcaaactgcccattctgggcaagaggaagaaccggccaaggtccaaggtgagcaaggtcagacacacctgggcatggacaaacttttgcaaaatgggcagctgagggggcaagtagtttgcctaaagctataaagcaggtaaggaggagatgctgaggtctggaggtgatgagagaattgagggatgatggctcaaagcttgccttgctccaaagcccaaactccacacacaactctacctctctacaccactatccaacaggcctcctgacaggaaatcccatcgagcttgttcattacaacatggctgcccacaaaaaatggctgttcatcaaccctgagcctcacacaaaacaggctgcttgtcctgcccaccaagcttggatggctgagagggaacagaggagccaggaagagaggggagaaacccagttcctcctcaaaagacatccaccattctttgccacctccaggtccagagaactttggactgagttccctaaaatcccaaagctaaacaacacctcaccagcattttgcctggccagtgaggaaactgaggcccagagagcataggtagaacctaccctggttcatccagcaaagccttgaaagacccagagttggaacccaggcaccaactaccgtgccacacccagctttttccaccacctcagttcacatgccccttctcaaagagctctgtggggtctccaaactcaggatgcttacaggccaaccttttcatagagcagactctcagcaaggcagccatgcctgggaacccctgacatcaccacccacccagcacctggaccccagagtgccaaaaagactcctaaaggaagtagggatacaagagaatcaggacaaagaggaagcccaagtagtcagaaccccagaatcgccatctagactccccctcaacgacgcctctcttcccaagggatccaactgacctccaggctacaaccacccccagtgacagtttaggaccaagactggggtggcaggaggaatcttccctcttctcatccccaaaagctctcaagttggaccaggtgaggcagggagaagaggatcaccttctttgtcctaagaagtgtggggacagaaagcctctcctgtcattgggaagggcaggtttcatgaacccacaaaacttgattttcatattcttttttttttattagtaaagatgaggtctcgctatgttgccaagcaggtcttgaactccagggctcaagtgatcctcccgcctcagcctcccgagtagctgggactacaggcatgcgccactatgcccggcttactcctatgttcttatggggacaagtataagggagggactgcaaggggcataaggaagtgtttttgagttaccatggcagcataggatgttctttctctctgtccctgggaccagggatgtatcgcaagggaggggagtaaggaggtgtttttgaattatcatggctgcataggatgtttttcctctgtccctaggaccagtgatgtatggctccctgcttctagaggaggaaagaaactacccaaccagagagagaagaaataactggtcctgacccttgagtacaaatggcttatcgtgccagaattaatgatgggaggaagggaccaagaacaaggagctcaagacaaggcttggggcccctgtgaagtacagaaagatttacctgagccaaggggaaaaggaatgtgggaggagaatttccccagagtggcgatgtcccaaacccctttcctgtccctgggaagaaaaaagcttgtcaaaagcagttcaaaacttattatatgacctagaggtgagaagcaagcatagctaggtcagggagagactcggaatcgctcttggtttcagaagggaggctccagactccatgtccccaggacctgacaatcttctcatagaaagtaggaggaccttcttggccctggccacgagggagctctggataaggggttcatatgaccctgaagagcatccaggtccttctgtccaatgggagaggatgacctcacgttcctctccctggacagaaaggattgcctggtgtggtaggaggagagcctcatgcccaagtgggagccaggcccccagtccctaaggcaaacggtatcttgtcccagagagaaagcttgggcccagactcttttcctcagaatcctaccctattcatgtccccaaaaggagttgggagtctaaggcccaagtccccgaggcaggaagtcttatgtccctaaatgacccctaagactagggtgtatgtaagttgtctgaggtgaggtgacagtaccctcagggcaggttcagaaatcaggtcctaaggtggggaacaggccttcacacacctgagttatgattcaaacccttggaggtagactcaggaccctgttccacagggatcctttatccatgccccaagggaagagtctcagggctcaggtctggggggaggagtcctcctgtttctcaggtgtacatcttaagttccttgaggaggaagctcagaccttacctctagacacacaagtcaccaaggtatgtatgagtctcctgtccctgaaggaaagctcaagtgtccttggcagagtgggtctcaggcccttaaaagtaggcaaagatctgtagggaggccccagacatcatctctgggatcccatgttgcccatgtcccctgagtagtcgtctcaggctcaagttcccaaggcatgggtcgtatgtccctgacaaaaagcttaggcccaaggtgggagggcctcaaacccctgttacagaggggaaaatgggatactgtatccccaaggtatgtttcagtcccttataattggggtaaaagggtcacatatgctcgtggggtggggagtctcagatccccaaaaccactcagacaccagccttgagaagaaggatctcctaaagacttcaccttgtctgagacctttgcagcaggacaccaggcccctgaagaggcctcagactcggtctctaaaaacctcagtccataagcaggtggatcttaggccctaggatccaacgctgtgagtctcattttcctgaagaaaggttcaggcccctggtgggggtgctgagggcccatctcttcttacaagaagcttaagatcctgaagcggttcaggcccttgtctcccaagaggtaggtctcaggccactgataggaaatgcagacctttgtcactcagaaaggagataagtaaagctgctggtcattgggtgttggttttggtccctgtccccaagggcaagggaatcatatctccctgtgaaaagtcttacatccctggaaaaagcttagaagatccctatccttaaagggggcgtgtgtgtgtgtgtgtgtgtgtcaggaccttgattctagaagcaggactctcaggcccctgaagacagacttaggacccttgaggtctcaggtctggctattcagtggtcctgtgcagtgttacccagcgaagcgggagaggattgtcctatatgcagagtgtctcagactcttgaaagggcttaggctccttggggatgttcagccccgatctccgaggtctccaccttatttgactttcctggaaggggaatctcaaacttctatcccagaggaaaagagctcttaagccactgaacacatacctaagtctcttgggagacctgagactcctactcaagaggggcgcgatcctacctgtatctcttggagaattcccacctattggccctatatgatgaggtcccagggactggaatgacgactatagaccttaaaagagacctcggatctttaagtctgacaccttaccgtaggcctctagccccaaaatcctggaggggaggaaagaaggtgtctcacatccctaccgccagagaagactgtcaggcccagtgaaaacgcctagatcccttggggcgatctcaaacagccttccttgagtcccttcacagtctgggggtcccatctgccgtggccgctcacccctcaccccacagctcttacctgctcgacagtggcagggtccatagcctcgatgcgtgctgcagccgcctcatactcgtcctcactgttgtagcctgcgccgacctcctcacgctcgggactgcccccgccaaccgcgccaaccccgggagcttgacgtcgccgcttgctgtgcccaggcccggagcagcagccgcccacgcctacggcaccacccacacccaccaccacgcccgcggcacccacacccgccgccgctgcgcccagcgcgtcgccgggaccgccgccgggaccacctgggcccccgcaaggaggtggagaagcctgttgtggccggggacccgccactgcaccaggcggcacggccagcgcccagcgatgaagagcgcccggcggtcctggtagcgggccttgaggcggtggcgaagctcgcggacgggcccccacgacgccggagtcacggtcgcgatcgccgccgcccacgcccgtgccgccgccgcccacgcccacacctccgccgcgccgcggcgccgggggcatcggcccgggcggcggcggctcgttggcggggtcggcgtcgggaggcggcggcttctttttggggagtatagtcatggctgcactgccgagtaccccccaacaaacccggcgcggggcacgccgggagagaacccggatgagggggctagtgtagtgcgcgaggcacgacgggaacggcgagacccggataaagggatcgcggcaccggttcgagaaccctcggcggcggaggcggcggcggcggcggcggcggcggtggcggcgcgcgggtcacgccgagaggagaacccggatgtaaagtccaagatgaaggcagtgcggcgagtttgtcttagccttctctccaagtccagcaagtttattgctacgcttgttccggccttctgcttcaaaggaaacagaaccaaaacaagcacctcttcgctccgccccctcgcaggttcttgcactaccgggtggggccccggggcgctgcgcacgcgcgccagggcacagccccgccccttactcggaagtacgtgggcaaaatcgccgccgccgccgccacaacaattgcaacaccaaccaattgagcagctgcgtgggacctcgacgacgcccacgggccaatcacaggcgagtgctcgccctccggtgccctccgtctcaaatttcagtcaaagtcgacaccctggttcccagcctttctccccgtcagttccgtcttgctcttcacttttctccccgaagctctgacctgcaggcgtcggtactgcggacggacagcgtggcctgtcccacgtacgacaggaaaaacacctcccctccaggattccaacttgaacgctgtcagccggaatgactggaaaacatcaacactcccgggagcatagctggcccctgtagcgtcacttccggtcccacccacctacaaatacccttccgggggaggcggacaccgcttcgccccggcaacagcctgagttctgcggtgattggttaagagacgccgtcactcgcggcataccgaccaaccttgggacagacaggcgccgtggggacagtggttgtttgggaaacagacacgccttctctggcaccacagcactctcggcctcgcgttgacctccccgcccctatggctagtgcgcaggcgcggcccagccttttttttttttttttttttttttttcctaattgagacaggggtctcactctgtcgcccaggttggaatgcagtggcgcgatcatagctcactgcaaactccaactcccaggttcaagcgatcctcccgcctcagcctcccgaatagctgggaccacaggcgcgcaccactacgaccggctaatttttttttcacttttttgtagggacaaagtctcactatgttgcccaggctgatctccagctcccgggctcaagcgatcctcccgcctcggcttcccagagtgctgggattacaggcgttagtcaccgcgcctggccaagcccagcctttttctaaaactgagtttgcttgggtcgatcgaggtttatgaaagctctgtcaccagtcagcgtctcaaaatggggttggcagaatccctgctattgagtagctggagagctacacgctaatcctagctctgcccttcctgtctgagtgatctttgtcagtcatttaaaacccaccccgtcctcaatttttgttgttgttgtttacttttttatagaacgcttcacgtatttgcgtgtcatcctttcgcatagtgccatgctaatctctgtatcgttctaattttagtatatgtggtgcgaagtgagcacccatccttaatttctattctataaattggcaataattctaatccgaggatcagagattaatgcttgtgaagggcctggtgctgtgcccagcacataggaagtgttcaataaagtagtctgcatggtggtgcagtggaaggatcccaggctttggagccagaaagacctcagttccaggcacagatggaccattaccaactgtatgaccttgagcaagtcattgtgtcacttttgagattacccatgtgtaaaacaggaatgataatacctgcccagactacctcagggaatggttatggggttcagatgagctgatgaaccaagaaggtatttggagttcacttccagtcttaggagacaaaccatacaacaggttgactgaaagagaccatgggaaagctgttttgagtatagccttgcctcccttgagatactaaccctagttgaaattcttccctgaaaggtgtaagtaataaatgggctctaagtagtgttttctgctcatgagacttaataggaggggactttcacgtttaccgggcctgttgtgttcagggctctgtgccaaatgcctatgcacattatcacattgaatcttctcatgatcatctcactccagccccatatatttcactcactacacatctaaaactgaactcatgatagcaatcatggctacccttcaccaagtacttactatgtacctagcactgagtgctgacagctctgatgttccctttaccagggaatagcactcccatccagccgtcgtccaagccagaaactgggagtcaactttgactgctccctcttcctcaactcccacatgcctgtcaatcccaagtcctgccaattctgcctcccaaatctctagactctccaattctactgccactactctggtccaagccactgtcccctaccacctggactattataaaagcctccaccctacttttcttccttccaggactgtttctctatatccactctccacagccagaatgatcattctgaaacacaaacttcatcatgagttttctgtttaagtctttagaggtccccactatctttaggatgaagtttaaaattcgcgtcatagcttcaaagctttttattatctagcctacctctccatccttcctctcctcacagcctcacactctcctccccagctggactgaactactttcagttccccaaaggcctgagctcactctccaacctccaggtcattgcacatgctgttccctctgcccagaacattgcatcctttcatttgctgcctggctaactccaactcattccctgtgtgttggccaggttaagttctcctgccatctgcatgcctctataacacatggatcttagttctgccacaccatgttgtaattacttgtctgccttccatgctcaactatacatcagagacaatgtctactttgcccacctttgtatccctagggctggcacatgatggaagttaataaatatttggtgactaaatgaattatccctatttcacagactagcaacctgaggcaagagaaggtaagtgattctctcacccagggattggaacccagatcaacctgaatccatggtctgtctgctcagtgctctatagaactcagccacacactagcctagtgtagccagtagcccagaagagagaatgtagggggcgtccacaaggaagggaaattcaccaaacaaagtgatgcttttattagggttaaattcagggttgtttgctgtcaggaagcctgggtttaagcctcctctaactaactatgtgtttctctgggtctcagtttcccgatctgtgaatcaggaagctggcgcagatgatatccaaggaggaatgtctcaggaccccctggcctgtctcattggctgtagatgaactcctcaaaccacactctttcatttctcctggatccccatcttccagaatacatcaccaaccatccatctcccataccttgacccataccagcccttctcctagccaaaagggattgaaatcagagtgttttcaacccccaagcccaacccagcccccaaacccacagagccaggagatactctcagtcctcatctctcctctcaggttttattgactgatggaaactacatctttgtcagccaccagctccatggggacagtgctggggacagggaacctgagatgatgccagatttcagcctgagagcagagttttggaaggtcacccaagagggagaagaaaggaatatgtgaaaaggaattgtaggggaggaggaggaggagaagttcctcctgtctcctataactcccaaagttcagaaacatcccaggccggagcccctgatgcttctggactgttgcccaagaacatggaatcagcccatgatctccaaatacagcccagctcttgctggttgccaggctcttatctcagccagtccagactccagcccaacccaggaaggacgcaaaccagaggagaagagaggaggaggaggagttagaggtggcccctctgattagggcagatgtaaatgctgcagcaaactggtcagaggctttgcataatgacacggcagcagctgctattgctagagtttgctgggggcccagcagaggacagggttgcggggtccatttccagcagccagggaaggggatggtagaatttgtgctatctgagtgtgtgttgggagaggcagcctgacccctcaggcaaggcctggggatggcaggtcgctgcagaggccacagcccatgaagcctgtgtttgcattccaagcttcagaatctgggaattgttgggccagatggagatgaggacctctcgtagaggccagatcagaggtgagggttctcttctctgaacctccaaagctccatatcccagccagagggaggaggaaatctcaactctccttcttaggctagagctcagatgtcggatcaaagctttgccttcatctgagagcccaaggggaggagcatgcaggagtccagctgggagagtggggccagtcccagtgtgctagggcaaggaggccaggggcctgtggaagcccagtgcttcagctcccaccaggaaaaatgtctggggtgggaggaagtttctcatttcctggctacttccccactatgtggaccatttcatgaaactccattgcatagttctcagtggggggggcagaaggggtgcccaagcctgcccctctctgcctcccaaaaatatggctttggaaaggagttcccaaaaatgaagaggaccctctgaatcagcaggcctacccctcacagggatgagatcttgacagtctcggggaagaggcaaggggtacccaggctggagttcctgagggtgctgccggccctgccaccgccgccaggggaggaaggttggctctcatctggggtgttggcaggaggggtagggatgctgataatggcagccacgaagtcccggctgtcgcagttcaggtcaaggctgtcatggggcttggcattgaggctggagcggctgtggacaagggtggagaagatggaaggctcttaaaaagttatcttaggccgggtgcggtggctcatgcctgtaatcccagcactttgggaggccgaggtgagtggatcatctgaggtcaggagttcgagaccagcctgaccaacatgatgaaaccccgtctctactaaatacaaaaaattagctgggcatggtggcgcatgcctgtaatcccagctactcgggaggttgaggcgggagaattgcttgaacccggcaggcagaggttgcagtgagctgagattgcaccactgcactccagcctgggtgacggaatgagactctgtctcaacaaaaaaaaaaaaagaaaaaaagttatcagccgggtgctgtggctcatgcctgtaatcccagcactttgggaggccgaggcgggcggatcacgagatcaggagattgagaccatcctggctaacgcggtaaagccccatctctactaaaaatacaaaaaattagccaggcgtggtggcaggcacctgtagtcccagctactcaggaagctgaggcaggagaatggcgtgaacccaggaggcggagcttgcagtgagctgagattgcaccactgcactccagcctgggtgacagagtgagactctgtctcaaaaaaaaaaaaaaaattaatacttgccacagcaatcatggcatttattgagcacctactgggtccctggcactgtgctaagtacttaagtacttctcctgcatccccaattatggtggtaaagagtgaggactctagagtcagatagtcctgggttcaaatcctggtcccactttaaccactccaaacctctctcttctctcatctgtagcatgggacgaacactatctcccacctcatagggttgctgtggagattaaatgagattaaaaatgatacgaagtgctcagagcagtgtctggaacacaatgtgcatacatatgaaaatgctatctctcatggttactcctaacagtgtccaagtccttacaaactgtccatagtaggatctaaggtgggaccctcgctcctttctgagtttgcctcttaccagtctcccccagctcactctcctccacccatgatagcttccttgctatgtctctaatgtggacccacatctgcctcaaggcctttgcacaggctgttcactctgcttagaaagctcttcctctagttatctgcatggcccactcctttgcctccttcaggtcttggctcagttgtcacctcagtaaagccttctctgaccacactactaaaactgcatcaccagccaagagtggtggctcacacctgtaatcccagcactctgggaggccgaggcaggtggaccacctgaaggtcaggagtttgaggccagcctggccaacatggtaaaaccccatctctactaaaaatataaaaaattggctgggtgtggtggctcatgcctgtaatcccagcactttgggaggtcaaagtgggcagatcacaaggtcaagagattgagaccagcctggccaacatggcgaaaccctgtctctactaaaaatacaaaaattagctgggcgtggtggcgcgcacctgtagtctcagctacttgggaggctaaggcagagaattgcttgaacccgggaggcggaggttccagtgagccaagatcgcgccaccgcactccagtctgggcgacagagcaggactctgtctcaaaaataaataaataaataaaaataaacataaaaaaataaaaatataaaaaactagctgggtatggtggcggacacctgtaatcccagccacttaggaggctgaggcaggagaatcgtctgaacccgggaggcagaggttgcagcagtgagccgagatcacgccactgcactctagcctgggcaacaagagcaaaacttcgtctcagaaaaaaaaaaaaaaaatgcagccaggcgcggtggctcacgcctgtaatcccagcactttaggaggccaaggcaggtggatcatgaggtcaggagatcgataccatcctggccaacatggtgaaaccccgtctctactaaaaatacaaaaattagccgggtatggtggcacgtgcctgtagtcccagctacttgggaggctgaggcaggagaatcgcttgaacccaggaggtggaggctgcagcgagctgagatcccgccattgcactccagcctgggtgacagtgagactccgtctcaaaaaaaaaaaaaaaagaatggatgaagaatgagttccagacaagataagcccaagcttccagcatggaggggtttgggttcgagcttgacttgctaggcctggagttatgaaatctcagagctactggtctaagctctgagcttccccaggtgtggctagcaggtaggagggctgcttacctctgaggggcatggctcctgcgcagccctgccagcatgtccagctcctgcatgctgccacggctgactgaggcagtggagttggcaaggcggatggcgcggcgcttggccctgcgagggcagcaagaagacagcaggcttccgggtcccactggctgggaagacacagaggtgctacggctggtgcggccacccggcgagacggctcccagggcttcactgaaggtgagctcatctgtgaactcatggcactatgggcagaagggaggcagggtcacggggcatcccatgggagctgatcccaccctcaagcctttgctcaggctgttttctcctttctggacattgttccctcttcccttcccttgcccattcttcaaggcttggctctcctgtagcctcttccaggaagctctgtgtgatttccacaatttgtagtgagcctcccatccaagggagagagctggcatggccgcagagggaccccctctattctgctatatcacctcacattaggcctcaccgttgtcttctctagacagtgcagcaagtggtgatgttgctgttcaaaggcagaacggttcctgacacaaagagcctgttcctcgccactgccgctgtcctggagtagatggagcagagcgataagggcagcaccttcctccccgttatggctcaccccaaccctatccaggccccgacccacctcaaggcccccattctgcttgtactgcaggaaggcattggtggtaccactctttgccaatcggatccttgccaagcgcaccttctgcagagagaggagataaaaggtcaggtgggtaagccccaaagtagactggcttggggtgtggggagtaggaggtgctcggatggaaagtgcggttacctgctgtgctcggcgcttgtcagcccgctggttctggtggtagatgcggctaaagttggacacaatgactggcacaggcagggcaatgaccaagacgccactgagtgagcagatggacccgaaaatcttgccagcaatggtgctgggcaccatgtctccgtagctggagcgaggggaggtaggccaaggtcaggaaaagtgcccacctacctttcagtcccccactccatcccatctaatccggactagctctgtgaccctggccaggcactcaaaccttctgagtccctcagtttcttgctctgtaaaatgctgggtggccaagtgagaaatgggcctggccctcaacccctaccatctgctgcccctgtccaagctacataccaagcacctgagtcagctagaaatctatgaaaaccaagcagaggggagcatgaggaagtcacaggcagtgaacacagcctcctggggagagagtcccagcaccacaggccagccgaagggcttcaagtcccgggaggagtgttttgttggttttggctgcctctgtcttacctgctctaggtaggaccccttttcattcccctataggggaatccttgaaaactgtccacatatgacaaaatagggaggagccttgaaaccctcctgcctttctccatgccacccacctcccacagagacagagcagagccaaccttactaacttgttcacagagagctcccctgaagatcagggagattctgtaactgactcgcccaagatcacactgcatactcttgttctgaccgcagaaccaatcagaactcctccagagaaacacagcctctgcagtcttcagcctctaagccttttctcaggctgtgccctaggatggctgttccttatttcggtattttcactcattttaagcattcaggactctgctcaaaagtctttccaacttggccattgctggctctgtgatgtgtcatctcagagcgtgtcctcaactgtgagacatgggcagccatccaccatcacagagttgttgtgaggacttgaatagagtaaaagccatcaaaatactcagttccagcccactgtcagcgctcagtatttgtttgtcagtctgatcctggacctccaaccagaattggggtttctacgctttagaaaccccaaatcaacttttttttgtacctctatgaagaaactgagcaaacccaattcattcagtcattccttcaacagatactgagcaccaactgtatacccaatcccagtgatggaaacttagagaaggatcacagcatctgccctagacagtatctttggaaagctcatgagttcgatgattccatttgatacttttatcccaactctgtttcttctgcagggatcgacaaaaaaataataataataaaaatgctgaaaacatcttgttctgggaaacatcaaggaatcacaaaggctcagaagtagtgccccacacagcagacaattctagaaggttgggagacatgggtccccaaaacagaaaaaggtgctagaaagccaacacctatgtatcctgcaccagaaacattcagagaactttcacaactatgatgtcattgaatcctctctagatgatgaagggatcagcatttcccattttacagaggggaaaactgaggccatgagaaaacgacatcaacagaaagagagcagctaagacaatccttgaacccaagtctcctgacctagaaaatcaaggcattgtcagagctgggagggatctgaagaattaagtccagctccctcagtttgtacagatgagcaaactgaagctcaaaaagagaaagaggccaggcgcggtggctcacacctgtaatcccggcactttgggcggccaaggcgggcggatcacctgaggtcaggagtttgagaccagcctggccaacgcggtgaaaccccgtctctactaaaaatacaaaaattagctgggcatggtggcgtgtacctgtaatcccagctacttgggagtctgaggctggagaatcacttgaacccaggaagcagaggttgtagtgagctgagatcttgccactgtactccagcctgggcgacagagtaagactccatttaaaaagaaagaaagaaagagatcattcctttaaacttcctaattttacagaaagggtgagtgtaatcgggcagcccccaacgcagagtccacactcacccaagcgtggtcatggtgacaatggtataccagaaggccgcagggatgcttgtaaagttggtcttgtttgtgcccttctcagcataaaacatgacagtggcaaagatgatgatggccatggttagggaaaagaggagaaagcccagctcagaggcacagctcttgagtgtgtagcccagaatcctcaagccctgtgagtgcctggagaacttgaagatgcgaaacacccggaacacacgcagggtgacaaaggcgccagagacatcgtcgttcttgggcaccaaaagcccaatgtagtagggcaggatggccaccacgtcgatgaggctcatgacactccgcaggaagcggcaacggctgggggcggcaaacagccgcaggaggtattcacctgtgaatatgagtacacaggctgtgtccatgcagaaaaaggcctgtgggaagcgttcgccacagggctgctcccttgaggacctgcgtgcagagccgcggcatgggatggtctccaccacattggcgatgaccgacacggcgatgaagaagccggtcacatagtagaaaacgagggctgcggtgctcgtgtgtggattctcgaaggcccgccagagccgctgccgcagggagctgcctgctggcagggctgggccgtccccggcctgctctgcctcctcatcctctgccaggcgctcggcattctccttctttcggtcccgatactcttcaaggcagcagtcaccgactagctcgggaaccaggccgtagaaagccagctcttcgtcgaaggcctggatgcactcctgccgtgggcaatgcagccgccccgttcggtagaagttcagcacatggcggaacatgtcagggtcgcgatcgaagaagtactcgcctgagtcagcatcgtagaagaattccttctccgagctgcccagcaaggtgtctgggtagcggtccagcgtattcttccaagtctcaaagcgccgtccgctcacgttcaccaccagaacctcatctcctcgagatgccttcacccccggtgccgggggcaggggttgctgggccaggggcagccagcccactgctgctgcccgagcaaaaggcagccacgtggccaggcctgccgccatcgtgccactccccaagcccagggagacttagtgagggtggcgtttaggagaatgtggctgtctccaggatggtgggggcttggagacaccttgagccacccaaacaaggaaactgggggtgtctagagaggccaagaggaaccaggaggaagaactaaagagatgggaaggagtctgggggacatttacagaacctaggaggggcctgggcaatgttctgagggactgagaagggccttggggacatggagaagagcagaaaaggggtgtggggatggggccaagaaggagctgagggagggtttagagagactgagatgattctaaaggagtcagcctgtgcctgagaggtgtctgggggcgtctagaggggccaagaaacacgtggggaattctctgcactctcaagagtctcagggaaggcagaagagcctggaattcctttgcagtggtggagaggagactggggcatccagaggggtagaaatgggaccagaggtgcttgaaagagactgagagtgcctggaagtgggggttctagaggggctgagacaggtgaggagggttgtccacaccctcaagacttctaggggaagcataagagggttagacccccctcatggatctggaaagggagctggtgcatcttgaggggtggctgtggatccaggaggttgtaaagaggctgaaaggtgtcttgggactgcctagagttgccaagaatagcccgggggggtgtctatactctacaggagttctggggaagaaaggagaggccagagcctcctagtagggctggagaggggaaggggttatctaaaggggtagacagggggctgggttattttttgagaggctgagagttatctgggggaggtgggtatctagacgggccaacaaagcctggtcgacactctcaggagttctacagggaggaaaaaggggcctggggaattccaagggccgggactcaaatgttaggaagttgggcacaatcccagagcacccaggggatctatgaagactaaataagaggaagggggttaaccccaaaatgggattaagaggggggtggggtgttgaaagggagttgggtgtgtctccagggaggggggctcctgggctttgcaggaagctggcaggagacgccgggagaaggctgggtcccaccgttgggggcaggtctggggaaaccacaccccgaggggctggcggtgtgtactgggcagtggcagtagcagcagcggcagcaggaggaagagaagcaaccacagccaggcataggagagaaggtggcataggcagggggagggtgcggggtccctggaaggaggcctgggaagggcaaggtccagtgggacccctggggactatcccaggatgggttagggcgtgggggctggaccagggaaggatgaggacagcgctagtggtggtccccctccccctctctctcggggcgtcctcacctgtgtccccgctgcaggagcagcaacagcggtggggctgggggtaccaaacacccgagctcctggccccctctgcagagctgcctgagttctcctcctcctctggctctctctccccgcccctctgagcttgccgggagatggagaggcagggaggggcctcgtggctccctgagccccctcccctaggacagccagagagggaccctggggagactccgcctcctacaaagctggttgggcctcagtcgcgtcatctggaaaatgggggtggcagggaacttcgccaattctctccacctccttcctggactcccctctcttcctgcccagctcctacccgctctgcccccaggggcccccacccccactcgcctgaatcagcagcacttagcagatccgatcgatgggaaggcgtcagttaatggccccagagcggagtgccacagggaatgatgcagcgctgtcccctccctgccccccagactgtggaaaggcaggagagccaggagtcgggggtaattgctggggagtgtttctctagatggccaagcttccgaagccgcccccttgaggggcgcagcatgggttacagccccagctctaagacttcggctgtgggattggagcacgggacttcctgtttttagatatgaaatgagggtaaagggaatgtagagggggacaatccaggtcccacccccctaccatctcaggcaggccccactccgagggggtagtctctcttatctgtccatatccagtggcctcaaatcacacctcctccgctagagggctctgcttctggatggcaggagcactgattatggaatgcctctggctggctatgggtgggttcaaaccccagctttgccactgacttgctgcatccttgagcaagtgacttgcattgtttcctcagttgtcagatggagagacttatcccaacttgatagcgtcatttggagcattacatgatgtgaaaggtgatagcactggacacagctcacaccagggatgcttaatcttaattaaaggagtgtgatgacaggggcactgtaatgcagggccaggcctagcctttcacccaagatttacccacccgtgtaaacttccaattgcccatttggcacactcctgatttgtccatttctacatccattcctccacctacccatccacccattctcccacccacacaatcaattcctctatccatccctccacccacccgtccacttagtcgttaatctacccacccactcattcatccatttgtaagttcaccccatttggctgtttgccaatctatctatctgtatgtatccatcctctgcccatctcttcccacccggaacacatgcagggtgacatcctctgcccatctctgtccatacatagctccacttgtcatttcttctcccactctttacccttcccattcattagctcatctacccatccatccattcccccaaccattggtccatttactcctaacctgtccataaacccatccatccacctgtctacctaaatcatccacccatttgtccatagacctattatccatctgtccatttacatctctactatccatcctctatccacctaccaatctatctacccatttattcatctaaccacctatccatccatccatttatttcccaatctatccatcatcagtccatgcaaccgttcacttatacatccatcggtccatccaaccacttatccatcctcccatctgtctactcatctatacccacaatcccatacatgtctacccatgtacatatctgcaggtatttcagctccactcagtttgaggggctggtcagcagtaaatggagacaggctggatgagggtggggaaaagagagtaacgttgcagccagagacctctctccctattccaatggtgtaaacctccccgcccccagcatattcctcctggttgaaaagaacgagacgagacagtcagtgggtgggcccgtctggccagatggtattttggctgcatagcctttacacacacacacacacacgtgttgctagaacgctgaacatggaccacacacccacccagcatccccaatcccaaatgcagagtagccaggctccagacataaattaaaaaataaaataaaataaaataaaaaagagttggtctctgggaaggagagctcatgcagagatgaagacagaagcccttgggagccaggaccaagaagaaggagaaatccctgccccttccctcaggatccccactccctggtggcctctgccctaagacaggatcattaacactaaccatcaggcctctagcccctttaatgtccagtctcccaagctatttgattttggctccagccctcatttttccaccacagcccaagggaatagcatcctagggggtaggaaggggaggaggtgggtgcagcctgcaggtctttagctggtttctcctggctctaggtctgggtcaggaggccccacgcactccttgctgagccgcacaatttcctgggacagaacttccatatcctaagaaacaaatgaaccatcaggggccagagaaggggacaggctgctcccttgccaaacgtagggtatcatctgtgatttccctcacaccctttcattaatcaatgctcagctgtgtctggcctgggatgagaaggtacttggagaagctcacagcacccccaacagtgggcagggctcagaaaagtcatgaggatgggtggggagctacagataatgggagtgggatgcctcctgtggcatggtgctgctgcaggatacaccaccactctggccacctgctcttctaagtgtgagcttgcttctcaaaggcaggagctgggtctgacccctttctaactctcagagatggggaaagtccttgggtggcagtttgggcagaaagatgtgtgtgtggacccatgggcatgggggatctatggtagacaaattggtggacgaatgaattgtccagaggacagatggagatcaacaggtgggcaggcaggtaactgggtgggtgaaaggtaacacaaggggcaattgatgagtagataagagaatgatatgtcaagaaatgggtggcaggacatggggtagacaatgagataagtaagtagtagattgggtagatggacagatgggcaaatggttgggtgaatgtgtagataaatggatgagcgggtacatggaaggaatgaatggataataagttgatgagagggtggaagatgagagcatgatggagtagttgatgagtgggtaggaggatagctgggaggacaggctgggtgggtgggcaaggggactggcagatgacccaggggctatgtggctgggtaggcaggtggctgggtgaacagatgggtaggctggcaggccacacttgccttgtgcaagtgcatattcttggtgagctgctcctccagcatgttctgcagcttcttgttcatctcccgaaggttctcgtcgcctggcttcactaggtctctcaggacgctgcccagcccgctgcggtctgtgtggcctgctgccacagacacatctgcaagggcccaggctgaaaaccaccccctcggcagagccagaggagagccaggcagagccagaggagaaaagagggagacgaataccaggggagaaggcagcaggaaaagccatgtcatgtaggacagaggctttgacatacaaaacctagctctgtcactcactagctctatggccccgagaaatgaggataactaacttgtggaactggaaagatgcacatgactgtatgtgaagcacagagcacacagaaagtcctcagcacatgttggtcagtatgattctgattaataaagaaaaatctgtgaaggagaaagtttgaaagaaagcaaaagcaatgaagatacagagaaggaaaacaatatagacagcgagacaagatgaaggagtggggtgaaaaagagaaacggagaagagagaagggagagagagaggagaggaagatgaggcacagggagaggaaaggagaaagtggacagagagacacaatggagaatggagagtggagagatgacagagaaagagagaagagggaggaggcgagatcaagagacagtgctttcctgttctcccctccacaggccatggtcttgtcagtagcttcgctgagttccgagaggagaggagagaagccgcagcacagaatggagagggagggccaggtgaaggctggaccagggctgagggccggggaggggacactgaccgatccggctgtccatgacgtaggtctcaatgatggcgctcttccggcagaggtcctctgccatggaagcactgctcacttccaggtgcttcacctgcaagatggcccagcccacctgagacccctctactgtacatgttcacacatgaggcgggcccgggcagaccccacacccacaagggcacttcaagtggggatgggcaggcaggcaggcaggcagcaccttctcctccagcatccatttctcctgctgtgtctctgccagccgctgaaagagctcagccacttcctcatctgacagctctgctggccgagggggctgggcttgagggctgctggataaggactgcaggaaagagaaggggagaggccagccccgggctcagcaccaccgaccccagacaggtgtcagggactggggaggagaaccaggccagaggtgggtgagagaacatgggccctgaagctgggactgttggcccatcttggtaccctcagactctgttttctcctctgcctaaatgggggtagagagtaaccacatcagagccttgtggagaggattgaaggaagatcccaaagcaaatgagatctaactttcagctgacaggaaaactggaagagagggacatgttaaatcataccaccaggaagccagcagaaaaacccaaaaggtagcatacttcctgtggggtgactgggctggcctcttcaacaaattggtctcaggaaaaaagggaccgcactaaagagatttaagggccataaaacaaccagatgtaacatgtgctctgaatctgaatgctagttttcataaaaccagcaagaaaggacattctggggccaactagagaaatctggttaaggtcaaagtatcagacgacatgaattttttttttttttttgagacagaatttcactcttgttgcccaggctggagtgcaatggcaagatcttggctcactgcaacctccaactcccaggatcaagcgattctcctgcctcagcctcccgagtagatggaattacaggcacgcgccactacgcccagctaatttttgtatttttagtagagatggggtttcaccatgttggccaggctggtcttgaactcctgacctcaagtgatctgcccgcctcggcctcccaaagtactgggattataggcaggagccaccgcacccagccaatgacatgaaaattgatcaaattgggaaggtagagacaacagttgaataaaaaacaggttaatctcatctaggttttaaaaagagagagaattctggaagggtatgaactaagaatttattttatttatttattttttgagatggagtttcactgttgcccaggctggagtgcagtggtgtgatctcggctcattgcaacctccacctcccaggttcaagcgattctcttgcctcaacctttcgagtagctgggactacaggcacgcaccaccacgcccggctaatttttgtattttagtagagatgaggttttgctatgttggccaggccagttctcaaactcctaacctcaagtgatctgcccgcctcagcctcccaaagtgctagggttacaggcatgagccaccgcgcccagccctgaactaagaatttataatggtgacgtctggatggtgaaaatattatttttttttgacatttaaggtttttttgtttttgttttttttttaaatagagtcggagttttaccacatttcccaggctggtcttaaactcctgagctcaagtgatccgcccaccttggcctcccaaagtgtaggattatagggatgagccaccacacccggccagacatttaaggttttaaaaaaatctttgctcatttgtggtttttaaaaaatgtactacaatgagcacatactatttgtggaacaataaaaaagttatttccaaaggaaagtggctggtaaggaggctgacatgacagccggcaataataattagtgatcattacaagttggaaaaagggaccttctccttggatggtgcacctactatgagccacataatttatggcaccagagaagggggaattagcccacagatgattaaacagaaagtcagagagagagaatgactggcctgtcctgcatgtcgcaatctgaatccaagttggtgggcttggggaaaagttgacaagaaaatatgtgtgctgcgcccaaagtaggagatgggtttaggtgaggagaaaaggggaggggttctcagatttttgggttgagagaagctggagctgtaggttcttcctttccccttaccctggctggaacagccgagctctccttttcccgcaagatctcccggtagctgaaggaggagatgctactgctgtcccctgtctgggtccggcttggtgagttcatctctgagagaaccagctcctcaaggcctgggtggtggagggaagagaaacttgagccccagtacccctgagtcccagggcagcaaccagcaggaagaggcagaaatagatttaacagagatggaaagagagacacctgggcatggggaaaggcagaagcagacaggaggacagggagagacagagacagaaaaaagagctgaggctgggcgcactggctcacacctgtaatcccagcactttgggaggctgaggtgggctgatcacttgacgtcaggagttcgagaacagcctggccaacatgaagaaaccccgtctctactaaaaatacaaaaattagccaggtgtggttgtgtgtgcctgtaattccagcgattcaggaggctgaggcaggagaatcgcttgaacccaagcaggcggaggttacagtgagccgaaatcgcaccattgcactccagcctgggtgacagagtgagactcttgtctcaaaaaaaaaaaaacaaaaaacagaaagaaaagaaagagctgcctttctggagaaacacatacaaaatgagagggagaaaatggaagaggttggagaaagagaacgacatgggtacacatgggtctcaagtggcagacacacttggacacagggttcagagaaaggaagacagctagagagggcacagggcacatccacttgcagaaagaaaatgccagagatggaaagccagagcagatgatagaaactgagaccctggtgaaagaagtgagccagagcagagacagagagaaaaaaagatgccgggcgcggtggctcacgcctgtaatcccagcactttgggaggccgaggcgggcagatcacgaggtcaggagatcgagaccatcctggctaaaacggtgaaaccccgtctctactaaaaatacaaaaaattaggtgggcgtggtggcgggtgcctgtagtcccagctacttgggaggctgaggcaggagaatggtgtgaacccgggaggcggaggttgcagtgagccgagatcgcgccactgcactccagcctgggcgacagagcgagactccgtctcaaaaaaaaaaaaaaaaaaaaaaaaaaaaaaaagatgcaagcaggctctcgtacccacgcacctaaatctcagtttaatctaatggacaaggtgaatgtattgaatgtatggtatacgattgtaacgtttcccaagattattattattattattttttagacagagtttcagtcttgtcgcccaggctggagtacaatggcgcaatctcggctcactgcaacccctgcctcctgggttcaggcaattctcctgactcagcctcccgaagtagctgggattacaggcgcccgccaccacacccagctaatttttttgtatttttagttgagacggggtttcaccgtgttggccaggctggtcttgaacccctgacctcaggtgatccacccaccttggcctcccaaagtgctgggattacacctttcccaagattcttacattcatctgtgataaaacagaaacaaaactcctttttaaagaaaggttacttcaggagaccgagtgcctcagagagaaattgatttggtgagagatacacatctgttttgccacatcacttaaagccctcgaggatctctggcaagggtggggtgactgagtggggatccgtaggtatcccgagtgggggaataagggaccaagttttctctgagtctgtaatctaagagatgcaccagagccatcactgcattttacttacttaaatgtatttataggccatccccgtcttaaaaaaggctgaagcaactaaagttgtgtgtgtgtgtgtgtgtgtgtgtgtgtgtgtgtgtcttctgcttgaagtggcagaaataacagattggattagctgtataatgaaaacaccacagcgttgctgactatgtataagtctgtctccgtagctcaactgggggcttctagagggcagagactcagggagttttatatcagggaccctgtacttgagcagggagatttatagaatgagagattgtatacaatagatttagaaatgccaagtgaggtgtgggagtgtgtaatgtagtacatacagtgaggagacagacagagatataaacagaagagacgaagaggacacagagtggcgggaagagataaagggacagagaaaagaaagggcgggggccgggcccagtggctcatgcctataatcccaacactttgggaggctgaggcgggcggatcacctgaggtcgggagttcgggaccagcctgaccaacatggagaaaccccgtctctactaaaaatacaaaattagctgggcgtggtggtgcatgcctgtaatcccagctactcaggaggctgaggcaggagaattgcttgaatccaggaggcagaggttgcggtgagccgagatcacaccattgcactccagcctgggcaacaagagcgaaactctgtctcaaaaaaaaaaaagagagagaaaaggagaaaactagagaaagaaagcaaggagataaaggcaaacatagaggaaagagagagaacaaactgagacagaggcagagacagaaacagagaagagacagggcaaaaacgagagaaagatagaaataaagagagaatgcagagaaagaatcagaggagagacagagaaaaggtaaaagatggagttccagagcgacagaagcaggaaagcacagctgaggaagaggcaggactaacctgcagcctgcaggcccaggccctacctcccccatgcctcagcctcctctccctgtcctagtccctcacctgagcggctcttgctgttagtgaggatgtcctgcagtcgctcctgcagcttatctgcccgtttccgctccaaatgcagctgccgcttgaggtccttgagctgtgggggacaggggtaacatgaggactgaggcccagtgggcccataggagggaggctacaggtaggagggagccgtgcttgggcaccgctctgtcttaccgcagcactgcccttcttctccaggatcctctgcccatccactgtgtccttcacctcctgtgggagaaagcaggcatggctggtagatgccggaagggctgcctgaagcatgctccctccctgcccctcctgtacgctgaggatcaggggtgtgtctggggctgtgcagtgaccactgacctgcttcaggctgctaatggtcttcaggtggcagtcccgctcctcctgggcctgctcgagctgatcccgtacatcctgtagctcctcctccttgccctgcaaagcagaaagcagcttaggcattggcttgggaagcctctgtcctcccaggagggcccgtcactgtctggagagaggaacaccatcatgcgagaggcaccttcagctcggcagcgtgctgctcccgacactgcttgagggcttcctcttgttcctgctgctgctgctgcagggattcctacaagacaagtcccaggtctggccacagccccccagaaggtatcatgcccagttaggggtatgagggactgcaatgggggcccagaggtatgcagaaatgaccctcctgcagggaaccccacacgcccttaggcaatatgctgaagtgtcacatctaaagttgcaccattcgcatggttgacttagatttgcatttacattttattttatttaacaaaacatagcgcttactacatgccaagaatgttctaagagttttacatatattaactcattttctataatcctcccgtaatacctagatggtagatattattgttaccccctttttaccattgatgaaaacaggccacagagaggtcagataacttgcccaaggtcacacagctaggaaatggcccagccaggattcaaacctagacaaacaactggctccagcctgtgctcttcactgctacatgacaatgcctttcagtgtattatgagatttccagaaaatggcaacaaaggttctttttccgagacagagtctcactccgtcacccaggctggagtacagtacacgatatcagctcactgcgacctctgcctcctgggttcaagtgattcttctgcctcagcctcctgagtagctggaattacaggcgccagccaccatgcccggctaatttttgtatttttagtagagacagggtttcaccatgttggccaggctggtcttgaactcctgacctcaagtgatccgcccacctcggccttccaaagtgctgagattacaggcgtgagccaccgcacccagcaggttcttgttcaataacatcagtgtattgcattaatttcctgacagaagtacagtttcaggagaaagaggtgcctttccaaatttgcacaaaggcagggcagccttaacacgtgacagtctgtcctatctgatggccatcccctgatccactccagagggctgctattgagccaggggactgtggggatatccctaagtccagaaaatctcgggaagttccagggcctgaccactcctgcttctgtggtttgacatgagggccccaatcagcctctgttcctcaccaggcatcaccaactcacctcggcttccttcaagcgccgttcaaaccagcccttggctccatccatggaatgtacctgagcttgaagttcttccactgtctgctggagagtctccagctcccgtgtccgggcctgggatggggcagactgtcatgggccaggaaggcagaggagcgggcacctgatgcatgccacccactggcctatcagcaacgctgtggttcccaggttttagaggaagaagggcatcatcatctacccacccaccttctcctcccggatctgcccacggagctcctcctcctgacgcttcttgtcttcatgcagctctcggagctcacgctcatagcgggcacgcacccccagcacctccttctcatgccgtagacgaactgctcccagctcttccttgtgctgggacttctcttgcagcgtttccattgctagctcatccagcatggccttccgcttctccgcactctgggggccaggacgatggcagtcaacttccttccacaacatcgaaaaaaggcctccaaccctcttcccatgcccaaggaactagccaaactccactccctcccatccccactgaactggctaaggcactcacccatccttatagaactggtcactttctttctttcccctcccactctcatggatttggccaagaaactggtcaaccagaaaccagtcaattttcctttccctcctatccccacatgtttggttatatcacctcctcccatccccatggactgagccaattcctaccccccatcctctcccttcaaccctcatgttcccctaccttccgagcctcctgtaattcctgggtcaactgctccttctcctgccctatttcttgaagttgttccagcagtcgactattggcccgtaatgactcctaatgcagacaccaaagggaaagagtttgataaagagcatccagtaggtgctagtcacccaggaccatctggtagaccatctcccttctccctggtaaagttggtattgtgatctcaatttctggataggaaatatagcagagactgctagttgctccccagtattcattcttccttacttccctagcaataaaatttatcatcgggcatacagctgtctagcagatgtttcccctcctcccttatggttaggtgtggccatgtgatttatttctgtatgtggaagtggtgagtgtaatttaggttatgctcttaaaggaaaggggcacactcttccctgcccctttcctccttccttccagatagaatacaaacatgatggtcggggagtttcagcaaccgtcttggatgccaagataaaagtcttgtgttgaaggtggaggaacagcaatggagaaagaacctgggtcacagatgactggaaagccatcattccatccctgaataacctacctggacttttaatgagagggaactaaatttgtatcttatttaatctactattattctggtttctattatggaatcagaatggatattgcttgggaggctgagccgggtagatctcctgaggtcaggagtttgagaagcctgaccaacatggtaaaaccccgtctctactaaaaatacaaaattagctgggcgtggtgccaggcgcctgtaatcccagctactccggaggctgaggcaggagaatcgcttgaacccaggaggcggaggttgcagtgagctgagatcgcgctactgcactccagcctgggcaacagagtgagactccatctcaaaaaaaaaaaaaaaaaaaaaaaaggaggccgggcgtggtggctcacgcctgtaataccagcacttcgggaggccgaggcgggcagatcacgaggtcaggagatcgaaaccatcctggttaacacggtgaaaccccgtctctactaaaaatacaaaaaattagccgggcatggtggcaggcgcctatagtcccagctactcgggaggctgaggcaggagaatggcgagaacacgggaggcggagcttgcagtgagccgagatcacgccactgcactccagactaggtgacagagcaagactccatctcaaaaaaaaattaaattaaattaaaatttaaaaaatgaaaaagaattgatatcctaactaactgaagaggctcagtttcagagaagtgaaatgacttgtcccagaacacacaggtgctaataagttagggagccagactggaacctaggtcctcctgactccagtcttcccactccaccttactggggacttcactgggccattactagggaactaggaagagacaggccagagccaaaggtgttacctggagctgggagttgaggtcatctttctgtcccataaggtcctcgtactcagcctgctgctgctgcaactcagctgccagcccagtggtctgttcccggagcatattcagttcttgggtctttgctgtttggatctggagaaagtagtggtgatgagaagtagagtgaaagggaccccaggggccagggacagggtatgagccccctagttccagggaaacagggagggaggtgggaagagaaccaggaagagagaggaaatttcaaacagaaaaacaatgaagagaatgggtaaatgtggtatgttcatacaatggaataccacacaacagtaagagaacagatctgtgctgccacgtggataaacttacatagtgctgccagaaagaagtcagagacaaagagcagctgattccatttatatgaagttaaagaacaagcgaaatgaatcttatgttgctagagatcagaataatggttacttctgggggagtactgactttgaaggggtaaaggggaccttctggggtactaaaagtgctttatactttgatctgggtggtggctatggtggcggggagagagagagaaaaaaaagagagagacgaagagaggattcactgagtgtacacttaagattagtacatttcatgcactttactagagagaaactagaaacaaagaaaagcagaagccgggcgcggtggctcatgcctgtaatcccagcactctgggaggccgaggcgggtggatcatgaggtcaggagttcgagaccagcctggccaagatggtgaaaccccgtctctactaaaaatacaaaaattagctgggcatggtggcacacggctgtagtcccagctatttgggagggctgaggcaggagaatcgcttgaacctgggaggcggaggttgcagtgagccgagatcgtgccatagcactccagcctggacaacaagaccgaaactccgtctacaaaaaaaaaaaaaaagcagagataggccaagcacagtggctcacacctataatcccagcactttggaaggccgaggtgggaagatagcttgaggccagaagtttaagccagtctgggtaacatagtgagaccctgtctctacaaaataattttgttttctcttttttgagatggagtcttactctgtcacccaggctggggtgcagtggcacaatctcggctcactataacctccacctcccaggttcaagcaattctcctgcctcagcctcccgagtagctgggattacaggtgtgcgccaccatgcccagctatttttttttgtatttttagtagagacggggtttcaccatattggccaggctggtctcgaactccgaaccccaggtgatccgcccgtctcagccttccaaagtgctgggattataggcgtgagccactgcgcctggcctaatttttgtatttttagtagagacaaggttttgccatgttggctaggctggtctcaaactcctgatgtcaggtgatccgcccacctctgcctcccaaagtgctgggattacaggtgtgagccatcatgcccggccaataagttttttttcgttttgttttttgtttttttgagacagagtttcactcttgttgcccaggcttgagtgcaatggcacgatctcggctcaccgcaccctccacctcctgggctcaagcaattctcccacctcagcctcccgagtagcttggattacaggtgcccaccaccacacccagctaattttgtatttttagtagagacggggtttctctatgttggtcaggctggtctcgaactcctgacctcaggtgatccgccctcctcggcctcccaaagtgctaggattacagaattgagccaccatgcccggctttttttttttttttttttttagacggagtctcgctctgttgcccaggctggagtgcaatggcacgatctcggcttactgcaacctccgcctcctgggttcaagagattctcctgtctcagcctcccgagtagctgggattacaggcacacaccgccacacccagctaattttttgtattttagtagagatggggtttcaccgtgttgcccaggctggtcttgaactgagctcaggccatccacacatctttggcctcccaaagtgctaggattacaggcatgagccaccacgcccttttttttttttttttttttttgagacagagtattgctctgtcgcccaggctggagtacagtggtgcgatctcggctcactgaaacctctgcctcctgggtcctggttcaagcaattctcctgcctcagcctccccaataaaatttttaaaagttaaaaaaaaaaaaaagtagggatggatggccagagagaagagggctggacgccaacagaaaggagcaacagaaacaaagacaggagaacagcatggggtccagaccaccctaccctgatgtggaccagaagcagatggagatgggggaactggagagggatcagcaagggcccccaggtgttctttacctgctccagggcagccaggctagtcctcaaggcattgttctcagccaaaagcccttccacttgttcctgtgcatctgcactctggatggatacctggccccacgtccacagcaggtgagagtgggtccagaacagggggacaggacctacccacgaccaagaaagaaaggacacacacacacacacacacacacacacacacacacacacacacacacacacacgaaggcctgggggaagcaggatccctgggaccttgcctgactatgtagtacccactcaggctgcccccatcctgaaccccagctccctgagcccacgcagtacaatatacctgatcttgtagggcccgcaaagctgctgcatgttccaggcgctccccctgccgctgatctctcagctctgccaagctctgtggagaccaggggagcccattttacacctcagcctctcctggggtgcatataaccgtacagactctctgtttgaccacccagcagcatgttctcagcacctgtgggtctcagactatccagccaacagcaatctcaggttcacccagacgccaggtcactaccctcaggggcctcagacacagtcaacccctctatcccagcgtacaagatctcaggcacgactagactcctggccctagctgctacgcggttcaaactcactcagctcccatccataagaagtctcatactcacccagattctagcttgggagctccaggattctcagacacagtcagccccatggatctcagatgtagtcagcacccaaggatgacagtttcacccagcctcccaatcccaaccaccaggggtttcagacacactcatctcccacgtccctacttcccaggtgagatccacccaaactcatagtcccagatcctagaggtctcaaactcacaacctcctagtttccaggtcctggtgaactctcagactgaccccttcacctgtcactctgctccccagtctcttggaatcttcagacccagttaaccaccagttcctgggggtctcagctttacccagactcccgtctcagaccccatgttcccagtttctagggacttcagaaccacaagccaccatatcctccattccaagggacctcagactcaccttttctagaaggaaacccagaggcttcagaaccatccagcccccagtcctcaggagcctcagacccacctaaacttctgctccagcccctggaggtctcagactgaccagctttttgttcacagccctcaaggatctcaggactacctagcccatatgatcccacttcctaggtgtcttaggcccaagccagcgcccagatcctgaggatctcaaatgcactcagccttcagccccaactatctcacccttgaaagttgtatatctacccagccatgtcctcagcccttgggagtcccaaatttactgacatcccagcccctaaagatttcaaagtcacccagcacccagggagttcagacttaccccagttcctggtcctaggccctagtgaccacagattcatccagactgtggtctcaaacctccaggagtttcagatttacacaaacttatagcacacagccccctaagtccttagccccctgagatcttacactcatgaagactcctataacaattcctagggctctccaattcccattttcctagctcctggggggccccagaacccatttccaacacaggaaatctcagactccccagccagcctccatggacctcagacctctccaggctcccagtcctggcccctaccccagggatctcagaacccagtccccatcacctgattggcagcctcaagttcctgctgcagcttctgggttcgagccaactgggctttgtgatcagcttccttccgttgttgtaattcctcaatcttgttcctaggagtgatggggagggggtgtgttggacatggcttgaggcccagtctcctagctctgcccctgtaatcttcactgggcactgtcccaattgtccaccaatacccgcaaatctggcagttacctgctgtcattaaacagagtctccttttctgtctgcagacggcaaaaactgggcacagaaggacagatgtagatgggtcagttccgtaagttaattcccccctcggcccccagtacccttgggaaaaagaaatttacctttcttgtttctttttcagtttctcggagagctggggagagaggtacagacaagtgataacattgagaataatataaagacaaacctaaaattaataaatatagacacttcttattaagtcatttttggaagccaggatttacttatgttgtcttgtggaatcctcaaaatagccctgacaagtgagtagtaccagttttacaaatggggaaacagagtcttggaaaggttaagtaatttggttgctcagcgggtcagcaacaacaatattatctccacccagatccttcaggttccaaagcccggtatttatgctcccaacatagtggccaatggccatgttatagattggctaggctgggaggcctggaaagcaggatatcatgactgggtgccgcacccctgggtctccaggtcctaagataagagccaggagtctgtaaatgcttgcatgaatgaatgaatgagtgaatgggcaaagctgagagatggatgggatgaaacttatcatgcacaagatatagtgggaccacattaactcattccatactgaaagtaactctgagacataggtgtgagtctctccatttcacagatgatgaaacctaggctttgatggggtacaatgccccttctgccctaggattgggaatggaatgggaaagaatccagcagattgggagcagaatgggaaagagccaagcagccgcaccttagcaagttcctcctgcagcctggatgtttcggcctgctttgagctctgcagggaaggatgagggatgggagggttgttgttagcaaggacaaggagaagccttcccctgccctcctgcctccctcaccccatcagcccacaagatggtgatgtcacagccatctccgtgggactatagacagaggtagaacatctgccctgccttctggcattccagctccaacagactcagattcacctctaagccttgcagctgttcccagagcaatctcttctcctctttctccatttcccatttcagctccacctctgccaacggcatgggggccaggacggtgggggccgggccccctgggggatccccctggccctcactgacagctgagaacttcccggcttctttcccatagcgttcctgcagggctggtgagtagaacagggatatatgatggatgaggtggtctctgaagtcccttgccatgcctcgaatagagggagaactggccttcaacccctcaggtggcagagtccctgtgccaaatgaccacatgcctaaaagacgaaggttcagctctatccatgcctctcacatttttttctttttttttttgagacagggacttgctctgtcacccaggctggagtgcactggaatgatcacagttcactgcaaccttgacctcctgggctcaagtgattctcccacctcactctcccaagtagctgggatcagaggtgtgtgccatcatgccgggctaattttttgatttttttgtagagacaaggtctcgctacattgcccagactggtcttgaactcctgagctcaagcaatcctcccacctcagcctcccccaaaaatctttttccgtggctgggcacggtggctcacgcctgtatcccagcactttgggaggccaaggcaggtggatcatgaggtcaggagttcaagaccagcctgaccaatatggtgaaaccccgtctctactaaaaatacaaaaattagctgggcgtggtggcgcacgcgcttgtaatcccagctactcgtggggctgaggcaggagaatcgcttgaacccaggaggcagaggttgcagtgagccgcgatcgagccattgcactccagcctgggtgacagagtgagactccgtctcaaaaaaatctttttccctagacagtcttgctctgttgcccaggctggtgtgcagtggtgcaatcatagctcactgcaacctcaaactcctgggctcaagcgatcctcccaagtagctgggactacaagtgcacaccatgcccagttaattttattttattatttatttatttgtttattttcttgagactgagtctttctctgtcacccaggctggagtacagtggtgtgatctcggctcactgcaacctctgcctcccaggttcaagtgattctcctgcctcagcctcccaagtagctggaattacaggcatttgccatcaaacctggctaattattgtatttttaatagaaatggggttttgccatgttggccaggctggtcttgaactcctgacctcaggcgatctgcccaccttggcctcccaaagtgctaggattacaggtgtgaaacaccgtgcctggcctaattattttatttttagtacacacaagttcctgctatgttgcctaggctggtcttaaactcctagcctcaagagatccttctgcctcagcctcccagagtgctggaatcaaggtatgagccactgtgcccaggctctcacaaatattttaagccctatcaaccactaagattctgtttactattaaattagcccaagctggtttcacaaatcccattctcaatccttgaagccccacccatagcccttgaaggccatgcccaccatatgctaccactgacttacagctgaatccctcctagagcctcctaattcctactcacattctactaagtctccctcctggtcatggaaccagcatccatcaccacagaagtcccagctgctctccaaagttccacacaccacatgctcccacactctatcaagctttctttcagctttcatcccagaccccacttacaatctgggctcagaatcttcccaacactccattcactttttcacttagcaaatatctcctttttttttttgagatggagtctcgctctgtcacccaggctggagtgcagtggtgtgatctcggctcactgcaagctccacctcccaggttcacaccattctcctgcctcagcctccagagtagctgggactacaggcgcccgccaccgtgcccggccaattttctgtatttctagtagagacggggtttcaccatgttagccaggatggtcttgatctgctgacctcgcaatccgcccgcctcagcctcccaaagtgctgggattacaggcgtgagccaccgcgcccggccgcaaatatctcctttttgacattcaagctgctaatctgtaacatctgctaggtaccagacactgaactaatgcagaatgatatcaccttttatctctactacaatcttctgggtgacagacatcactacatgcactgtgtagatgataaggctttggctcagagaggtgaaatggcttgtccaaagccacacagggcatgggccaaccctatttctgaagcccttctccttcccctgagaggatgacggccttccttgccctactcaagccccaatgtctccgcatccccaggagggcctctatgcacctgccacgttcttctgcaaggctgtgttttcagcctgtagcctcagcagctccccatccacgaggggcccagcttgggcaacccctgctcctgcagccccctccttcagttgctggttctcttgctccagctgttccatctggctgcagagctgaacagaggaagagaaggggcagagaagcagagaatcagagcagtatttgctgaaacctacatagcatttgtccatgtactttacaattcacttaattcccataatgaccctatgatataggtgccctcccactttacaaataaggacattgaggcacagagatgttaaacaagttcaaattcacacatcttttaagtggcagagtcagagaataccaagagcataccaagtatgaggacaccaaaaaccattttcctcttcctactcccaacctcagagatgcaatccaagacctcaggctcctctggaagttgttagtgctacagacagcctcactgcaacccctcttctgtggagggctggatcctgggcccagagatagctccctctcatcctaagcaccacaaagagctcgcagggcatttccagggccaacactgatgacagctcctgcattgccagccgttagtcttggagaggtatacaatgccaatacaactaagccagccccctgcccaactcctggctgaagtacacttctcaaagcagtcctgagaaaattccttgtccccattttcagatgagaatatcgaggcctacagagaatttttattttattgcctgcaatattttctttctttcttttttttttttttttttgagatggagtctcgctctgtcacccagcctggagtacagtggcacgatttcagcccactgcaacctccgccacccgggttcaagtgattctcctgcctcagcctcctgagtagctgggactacaggcatgcgccaccgtgcccggctaatttttgtattcttattagagacggggtttcgccatgttggccaggctggtcttgaactcctgacctcaggtgatccacctgcctcggcctcccaaagtgctgggattacaggcatgagccaccgcacccggcctgcttgcaatattttctacccagaacaccaatcctctcatccagttcttcacctaactggcttctttgcatccctcagtgctctgctcagatgttgcctttaaagtagtatccctcaacacagaaaattccagtactctctgtcacagcactgttcatttctttcttacctagtactaatcaaaattttcttttgtaacaagcacagattctgaaaccagactgcttgaatgtgaatttctgctctgccatttactagctgtgtgacaaattacttaatctccctggaactcagttttcctcatctgtcagatagggatactaatatctcacaggcttatttcaaagattaaatgagtgaataatgtagagtacttcaaacaggacttggcacacagtaagcaccatataaatgtcagctatcactactagtattatttgtttactgttatcatctttctcctcatcccacccccagaatgtaagctacccaagagtggagatcattctgtgctgcttacaactgtatttccagaacatagagcatgtggtgggtactcagtaactatttgtcgaaggaacaattaagctgaaatgtcttgatgaataaggggtggtggcaggtttaacgtagctctctctgagagcacttccagttcctgggaggagttggaggaggaaggggactatgtaggaagtctctacgactagcccagtgctggcccagggcagatgcagggaaacaagctggatttatggaagaatgtctgcccctgcctcactctgcaagaatcatgataccatggaggctggaggcaggaagcagtgaggagtcagtcagtgaagccagcagttatgtgaataccaggggctctgaactaggagcaggactggggcactggaatgtattaagtaaaggagtgatgtcataagatctgcaggtcagaacagcctctgtggtgtgaactaagtagaagaaactagaagtgaagagaccagggaggcggctgtagaaacagcagatgataagtggtagaggctaaggcaaagcagggccacagggtggatataaaactttttttttttaaattgagacagagtcttgctctgtcgcccaggctggagtgcagtggtgcaatcttggctcactacaacctccgcctcccgggttcaagcgattctcctgcctcagcctcccgagtagctgggactacaggcacgtgccaccacacccggctaattttttgtatttttagtagagacggggttttaccacgttagccaggatggtctccatctcctgacctcatgatctgcctgccttggcctcccaaagtgctgggattacaggcctgagccaccacgcccggccataaaacttttaaaaagtcaaatattttagagggaagatgagttaatagaaggataatattataactaatgcttccatagctgatactatgtgcaaggctctgttttaagtgatttacgtacatttattcatttaatcctcacaaaagccctgtgaagaggcaggtactgttattatcatgacttccattttaaacatttgggaaccaagaaccaggcaagttaagtaacttcctcaaggttacagttagtaaaaggtagagccaagattttaatctaggccttctggttccagagtccctgctggtacctactacttgctcaactgcctctcctggtattgtacctgcttaaaggttattttcggttttgtttttttaaggtcataggcactatattctcagatggagccttagaaataccatttttgggccgggcgcggtggctcacgcctttaatcccaacactttgggaggccaagacgggtggatcacctgaagtcgggagttcaggaccagcctgaccaacatggtcattttctctactaaatgtcctctcccacccatgtcattttctctcatctctactaaaaatacaaagttagccaggcatggtggcatatgcctgtacttccagctacttgggaggctgaggcaggagaatcgcttgaacccaggaggcagaggttgcagtgagctgagatcatgccattgcactccagcctggacaatgagagtgaaactccatctcaaaaaaatttgctgccatgagacttttttccttaaaacacactaaaaacatagacaattatcaactgtggatacagaagatagatgagggaacaaaagacaatgtctccaactgcccagtagatttagaaacagacaggacactaaaatcaatggggagatagaattagtagctccaggatgaattatctggaagaggtagaaccccaggctcatgtcagatgaagagaagaaagagaaaagggaagaagctcgaacacttttccatcctatattaagcataagaactctgcctaaaaccccccaacaccttggagcaccacagcatcaaccccacattatacacatggagacttgaagctcaaataaaaggagtgacttggccaggaaccaggtgacctcagggctcaaagccttctaatcccagcagagtgagcggccccatctgtcaaattactgccccccagcagcaatccaggacctgtttcagcaccacggacagtgctccagggccagaccctgtccaatcactctctgccgctgttaggtttcagcccagatgacccctacccctcatttcccctttgactatcccaggcaccagcaccttgctgaactcggccattagtgtgctgttctgcaaacggaagtcctcctcctggctgtgcagctttgcctgcagcatctcattttcactcagcaatacctcgacttcctgcagtggcagacaagggccaggactccagcaagggcaaaaaggatagggaggtagggcaaagaaacagagagagggagaaaatgacatgggtgggagaggacatagggtacagagaatgaggtgatataggagaaagagacatggggagggataaaatgagagacagggaaaggaagataaagacatgggaaggtagagagaagggaatacagggaggaagagagcggaggaaaagacaggaagataatgattggggagagaggaagtagagatggggaaagggggagagatagaaaaggggagagggattgggagggagagagtgaaaaagacggagagaagaacaaacagaaatcaacagggagagaacagaacagggagaagaggaggggtcaggaaaagaaatgagttaggaagagagaggaatggggtggaagaaacaaggagttagagagagaaagcagaaaaaagagaaatcaccgagacaggaacaggagggggagagacaaagagaagattgggaagagaaatgagtcagagagacaggaacaggaaaacagacagagacagaaagagactcagagaaaagaatggaaagagagagaaggaaagagacacagagttaggacaaatacagggaaacaaggacagatacagcaacacatggcagtgaggtagtagcagatgtaaaggcacacaaagaaagaaaggccagtacaaggaaatatcagcatacagaaatagcccaccaagacatctcccagtcacactcacccacaagggatccccttacctgagctttcttgctcttgctcagtgcctaaagtgggggtgggtgggaagagagctaaagtgaacagagatggactgccttactaggatatggagacaattgtgccaagcgttttgggaggacaaggatgacaggggttgcaggatgggagcatcttcaaccacagaacatgtgtgacaatttggagcccaaaggaatgatggaatgagtgtgtgagtgagtgaatgaatgcaagtcttgccctggggccccagcacacataaatcatcctttcttggaagctcttgaggctggtggggggacaggggaggtagggagatgccctggtatttaaccatttatgggctggatctccagactcagaaactgtggcttcattgctacatctgtccatacatgtctctgtgggtccctcccacgcagtgtggaaactgtcgctcccctactgggcagccaagagcattgccagcttaggggaatcagcatcctaccaaagagaagtgcagcttcctgactgtcggattttctgcatactgtattcgttcatccaacaaatatttattgagcacatattatgtattaacattgtgctaggtatggctagatatggggacagagcagtgacaaaggagcacctcgaatgtcttgaggggccacaataggttatatcctatctcatctttagaggatctgagaggtgggtttgctctcattttcccaactggaccaggacagagatgggaagtaggagcacaaggcaggagtgtgagtagaggatgggaggcagattcgaggtagatttactgatagatttgaatatttaattaaaagtcagtgaatgagaatgagtaactgaaattagaaatgaattaaaagtaaattaaaattaatcactaaattaagcaggattaggtaaaattagcaactaaagagaattccattgagaatcctttaaatgactacgtgaaaacagcatgcaacattaggtctggttcactgtaggtgctcactggagggatgaatgagtcagataggtagaagcaagggtggatgggtaggtggatgggtgggtggagggaggtaccttctgagctttgctgaactccttatccaagtaggcgaccttctgtcgaagactggtgagttctggtgtcgggaaagcagggaaactcagcctcagccagtggcaagaaactgaaaggccttcctgccaggcctctgagggaaaacctcggacaccattccccaaagccacccccatctaataaggccctcctggctcaccaacaccattcttgcgtagttcatctgaaagctggtagttgtttgtccggagttccaggagctgagcctttgggggaggcaggaagggaaaagacttggtcaggaaagcgcccctacccctaccatgagggaaccaagcccctaagctccacagaccttacgccctccatgtgcctctgtagctactccttaagacctgtatgtgctacacccaaagtgaccttccaggccctcagaccctggctcaccttttccagctccacttataaccccagccagcctcacccctccatctcacactacaatccacgctgcactcaggccatcccagagcactgcccccagtcagggtcttgcttgtgtgagttccctggctctccatgcccacaggataaagttcctcctcctcatcctggctgacctctccacacactgaacacacactgtcaggggtgttgtccatatttctgaccagacctgggggcctctgatggcagggggttaagggcctgtcttcctccctctttcctaagggaaaagggtcaagtattctgcccaactttcattgagtcagggggctttccagggtccccccacctccaaggctctcaaaatacatccaggcccccttcaataattaagggaggaccaggtgcggtggctcacacctgtcatcccagcactttgggaggccaaggcgggtgggtcacgaggtaaggaattcaaaatcagcctgcccaatatggtgaaaccccgtctccactaaaaatataaaaaattagccgggtgtggtggcgcacacctgtagtcccagctactcgggaggctgaggcaggagaatcgcttgaacctgggaggtggaggttgcagtgagccgagattgtgccactgcactccagcctgggtgacagagtgagactctgtctcaaaaaaaaaaaaaaaaaaaaaaaaaaaaagaattaagggaaagtgccaggcgcagtggctgacacctgtaatccaaacactttcggaggccaaagtgggcagatcacttgaggtcaggagttcaagaccagcctggccaacatggtgaaacctcatctctactaaaaatacaaaaattagctgggcgtggtggtacgcacctgtaatcccagctactagggaagctgagataggagaatcacttgaacccgggaggtggaggttgcagtgagctgagatcgtgccactgcacactatagcctgggtgacagagaaagactctgtctcaaaaaaaaagaaaaagaaaaagaattaagcatcctcctccctaccagccctataggaccctgaggctggttctacccagcaaggccggttccttcccattaaggaacttactgttccttcccctaccaggacttttccctccctcccacgccaccagcctccactcactgttctctggtagtctgctcaaggtcagagggcttggccttcacagaatctttcctactcctgtcctctccaggacccagtgatctgtctctccaagtactggtccaagtggaatatcctttgtaccccccgagacttgccccccaacaaagcccagtagttctccctcattcatggcccagtgggatcaatgttcctcattcaagggtattcccactcccctcaagatctccccagtcatgatccattgggaatggccctacacccttcagggtaggcctctacaaggccttgggtaggccagttggatgactcttactcacttagaatccctttcagatgacagtggtcttccccattcatgggttaatcaactcgcccttccattctcagtgtccctcacacagggacagctggtttccctcattcaaggaccaattggattacctgtcctccctcagagttcctcccctccccatgcaggaccctgttcagaccccccccccagtgaggaaccctctcaacaagggcccattcatagtgcaatgctatggcctttcattgcatctcagagtccccccaaaagaatcaagtgggggtacctccccaaagcccagtgatcttccctccttgtagtccaaggtatcaatcttttacccctctggtcctccccccagttaatgggattaatggtattacccattcatggccttcttcaccccaggcctaatgggatcacccttaatcatccaatggtgccgccccctcttaggatgcactaccaaccaccaatggcacaggatctccacctcccaggaacaatgacaacatctggggtctttccccaatccccgggcacagtggtatctcccccaaaacttaccacctcccacccgctaatggttctgccctctcaagggctcccaccaccatgacgcaaacgacccaacacccgcttccttcctctccagacaaaatggtttcgccttctcaggatctccttccctcaaagcccattatcatcacccgccgacggtgtcccctgcacgggcccaaaagtctcgtcccctccaggtctgagtaaggtaccgcctacttaatggcgctctcccagcccacaatgctaacagagtccaaccttcaaagccgcagagtatctcggaatccaatagtctcaccactccgagcctcagtttcccttctccagacccaccccataaactcagggtccatcccaaccaaccccttctcagagctgatagcacgacctctcgctaccccgcccccggtcgcctagccgggtggtctttcccaccgcgagcggcacctgcatccgctgaaactcctcctcagacagagcttgcgccatgttcctccccccacccccccgccagctttctgcgcagacgcagctcgcgcctcctggcagtattaaggtcggaccaaaccactggccaggaatggagggggtagaacctaattccgaagggcagcattttggagacgcagagaagagaacgaaaccgacgagtcaggtgaactgtaatacaacgttctacccgaatgtaagtcatctgattggcttttggactcttctaggccacccattgtgatacgacattattacatccccgtttcatgggtggactcgtcgctagggaagtctttgccgacagaaaatcacccttccgcggtattcctttaatgagaatgggtaacttaataaccatagaaatgaaagcggaagcttcgctctggtcttgttcccgcccctcctccgggagaccccaaaggggaatcccacctcttgtaaagcctttggccttttttttttttttttttttaaggtttgacacttattttgttatcatgatactgcatgtcacgttaggtaaaggacttagccaccaataaaaatagcagagtggaaagagtgacagtgaatcaaacgaaaaagctacattaaaacaaaacaaaaacaaaaaacaaaccagggtggtgaaacaccaggctcattcaagtattagaattcactataaccctcaccgatctgagagtaagaaatggtatctcagtgtagtttttttcttattttcttttttctttctgtttttgttgttgttgttgttgttgtttttcttttttgagacggagtttcacttttgttgcccaggctggagtgcagtggcacgatatccgatcacagcaacctccgcttggcgagttcaagcgattctcctgcctcagcctcccgagtagctgggattacaggcacccgccacctcgtccgggtaatttttttttttttttttagtagagacggggtttctccatattggtcaggccggtctcgaactcccgacctcaggtagtccgcccgcctcggcctcccagagtgctgggattaaggcgtgagccaccgcgcccagccttcttattttcgtagaatttaatgatttccctgctgtggaaaaatatttccagcagggccgggcgcggtggctcacgcctgtaatcccagcactttgggaggccaaggagggctgttcacttgcggtcaggagttcgagactaacctggccaacatggtgaaaccccatctctactaaaaacacaaaaattggccgggtgtggtggtgggcgcctgtaatcccagctactcggaaggctgaggcacgagaatcgcttgaacccgccaggcagaggttgcggtgagccgagatcgcaccactacactccagcctgggggatagagcgagactctgtctccaagaaaagaaagaaaaagaaaagtattgccagccaggactctttgatttctttcttgatttaattgactttattgaaagataacgctattgatctgtctatatacataaatgcacccattttaagggtacaatttagtgagctttgtctaatgtatacaaccttgtaaccaccatcacaagcaagatagggaacattgatttctttgtatcctatcccaaaccccaccccctatcccaggtaaccaatgattggcttcctgttactggattacatttctcttgcagagtttcatgcaaatagaatgagacaggatgtatccttttctgtctggcttctttcactcatcataatccttttgagattcatccaagttgtttcgtgtataagtatctttttttctttttattgactagtaaaattccatagtatgggccgggcgggctcagtggctcacgcctgtaatcccagcactttgggaggccgaggcaggtgtatcacctgaggtcaggagtgcaagaccagcccagccagcatggtgaaaccacatctgtactaaaaatacaaaaataagctaggagtgatggtacacgcctgtaatcacagctactcaggaggctgaggcatgagaatcgcttgaacccaagaggtggagggtgcagtgagccgagatcgtgccactgcactccagccttagcgatagaggggaaaactctgtctcaaaaacaaaacaaaacaaaacaaaatccatagtatgactataccacaatttgtttatccattctcttagtgtagttttaatttgtgtttctcttattatgagtgagattcaccaccttgtcctatgtttattttatttttaatttttatttatttgtttttttgagacggagtttcactcttgttgcccaggctggagtgcattggcgcgatctcagctcactgcaacctccgcctcccaggttcaagcaattctcctgcctcagcctcccaagtaggtgggattacaggcgcctgccaccatgcccgactaatttttgtatttttagtagagacagggttttaccacattggtcaggctggtcttgaactcctgacctcaggcgatccacctgcctcggcctcccaaagtgctgggattacaggcatgagccaccgtgcccgaacttattttatttcattttattttattttgagacagggtcttgctctaccgcccacgcaggagtgtagtggcacaatcagggctcactgctgccttgacttcctgggctcaagcaattctcccacctcagccccccaagtagctgggactacagacatatgccaccaagaatcattttaatatctgttcttattttatttttttaatttaattattatttttcttttgagacagagtctccctctgttgcccaggttggagtgcagtggtgcaatctcggctcactgcaatctctgcctcccgggttcaagagattctcctgcctcagcctcccaagtagttgggactacaggcacccaccatcatgcccagctaatttttgtatttttagtagagacggggtttcaccatgttggccaggttggtctcaaactcctgacctcaagttatcctcccgcctctgcctctcaaagtgctggggttacaggtgtgcacaaccgcacctggcctctttgcatattaggaatattaacaacttttttgggtgagggtgtacggagttttgctcttgtcgcccaggctggagtgcaatggcgtgatcttggctcaccacaacctctgcctcccgggttcaagcgattctcctgcctcagcctcacgagtagttgggattacaggcacccaccaccacgtttgtatttttagtagaaatggggtttcaccatgttggccagcctggtctcgatctcctgacctcaggtgatccacccgcctcggcctcccaaagtgctgggattaaagacgtgagctaagctaccacacacggccttttccttttctttttctttttttttttttttttgagacagggtctcgctctgtcatccagactggagtgcagtggtgcaatctcggctcacttcagcctcgaccttctgggctcaaccagtcctcctacctcagcctcccaagtagctgggactacaggcacaggctaccatgcccagctaatttttttttaattttttgtagaaaccaagtcttactatgttgcccaggctggtctcaaactcctgggctcaagtgatccacccacatctgccttccaaagtgctaagatttcaggggtgagccaccacactaggcctacttttggtttttttttgtatgtgtgtgattttttgagatgaagtctcgctctggagttcagtggcccgatcttggcttactgcaacctctgcctcccaggttctagcgattctcctacctcagcctcccaagttgctgggattatgggcacgtgacaccatgcccgtctaatttttgtatttttggtgagacaggtttcaccatgttggccaggttggtctcaaactcctggctgcaagggatctgcccacctcagcctcccaaagtgctgggattacaggcgtgagccaccgtgcccggcccttgcctacatttgtaatatataaattatgttgtcacagtctccattccatactggattccctgacctcctggttgctttttttaaaattttgcatacattaacaaactttttttatatcgtaaagatcaatgggttttgacagaagcattttaaagtgttccacacatagatttttttcacatttcttgttagatttcttcctaattattttctttgatgctatggatgctattgtaaatgaggttttctctatcattgtatctctttttttttttcggtagagacaggatctcactatgttgccccagctggactgcactggctatttataggcatgatcatggcacactacagccgtgaactcctgggctcaagccatcctcccatttcaacttcccaagtagctgggactacacatgtgagccactatgcgtctttatatcctctcactggttattgttgatatatacaaaagccattgatttctctatgttaattttatatccttccattttactgaatacttttattgttagagtgttttatcattgattctctagggtttaccaggtacaaaatcatatcatctgaaaatagggatatctttattcttttccaatcagtcacactggctgtaattgatttctcttgcctaattaccattttccactaacaggaaccagggccccttagagaaatagctgattgcagggctggggcaaggaaagtacaagattagcctggaacatcttgttttaaccacacattgaaagaatttgaattaaaaaagaatacaagagtccaaagtgatctaaataaataaatggaggcgaagggaaaactcttcctcacagaggaatgccaactaataaatgtacaaggaatgatggaattagaaaataactatttggcaactactactgtaataattgttttaggcaagcatcattggccaggcgcagtggctcacgcctgtaatcccagcggtttgggaggccgaggcaggtggatcaattgaggtcagaagttcgagaccagccgggccaacatggtgaaaccccgtctctattaaaaatacaaaaattagccgggcatgatggcgggcacctgtaatctcagctactcggaaggctgaagaaggagaatcgcttgaacctggaaggcagaggttgcagtgagccgaggtcgggccactgcactccagcctgggcgacagagcaagactctctattaaaaaaaaaaaaaaaaaaaaaaaaaaaggctgggtgctgtggctcacgcctgtaatcccagcgctttgggaggccaaggcaggcagatcacctgaggtcaggggttcaagaccagcctgaccaacgtggtgaaacccggtctctactaaaaatacaaaaattagccaggtgtggtgggttcaagcgattctcctgcctcagcctcctgagtagctgtgattacaggcgcctgccaccatgcccagctaattttttctattttgagtagagacggagtttcactatgtttgtcaggctggtcttgaaccctgacctgacctcaggtgatcaccccgcctcggcctcccaaagtgctggaattacaggcgtgagccaccacacccggcccagagggctaatttttaaattttttgtagagacgagatctcactatgttgcccaggcttactttttaattataacaaggattagggtaactttataatggagaacactaccttaaccaagtcacctttagcgtcaccaggacagggacaaattggtattatgtgctttccgacgtaatgcactgagaaagacacaagtcacctctgtggtatttctgccaaaaattcataatctgaatcgaatcatgagaagctattaggcaaaccccaactaaagaactcatcaagacatcaacgtcataaaaaacaaagatcacttgcagtcaggagtttgagaccagcctggccaacatggcgaaacctgtctctaccaaaaatacaaaatttagccgggcgtggtggcaggcgcctgtaatcccagctacttgggaggctgaggcaggagaattgcatgaacccaggaggcggaggttgtagtgagccaagatcgcgacactgcactccagcctgggtggcagagcgagactttgactcaaataaaaaaaaaaagagaatgactttctcttaaatgtctttggagaacgactttctcttaaatgtctttgtacagaagagactgagactattatccttagaaagatctgattgcaaggttagcccttgactagcatctgccaatttggctagtaaacagtttgctacactgatacgagttgttcattgtggctgggcacagtcgctcatgcctgtaatcccagcactttgggaggccgaggcgggtggatcacttgaggtcaggggtttgagaccagcctgaccaacatggtgaaaccctgtatctactaaaaatacaaaaattagctgggcatcgttgcagtgtcctgtaatcccagctactggggaagccgaggtaggacaattgcttgaacccgggaggaggacgttgcagtcagcagagattatgccactctactccagcctgggcgacagagcgagactctgtctcaaaaaacaaaacaaaaaaaaacaaaaaaacaaaaaacaagagtggtttattgtgcctaaactgtttgtagaaactatgtggtttatgcggaacacctgcattccctcagagtctaggattctgatatgtgctaggtagagagtacctatgtgaccagtccccactaaaaagccttggccactgagtctctaatgagcttccccagtagacaacactttgcacatgttgtcacaactcattgctggagaaattgagtcttgtatgactccacagggcgactcttggaagcctgtgcctggtcctctggatttcagtctgttgctcaagggaggtacagagcataaagaagcctgtgcatggatttcctggatcccacctgtgtccttttttttttttttttttttttttttttgagacagggtctcactctgtcatccaggctggagtgcagtggtgcaacctcagctcactggaacctccacctcctgggttcaaacaattctccttcatcagtctcctgagtagctggcattacaggtgggcgccaccacgatgggctaattattatattttatttatttatttattttttattattattatactttaagttttagggtacatgtgcacaatgtgccggttagttacatacgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctataagtgagaacatgcagtgtttggttttttgtccttgcgatagtttactgagaatgatgatttccaatttcatccatgtccctacaaaggacatgaactcatcattttttatggctgcatagtattccacggtgtatatgtgccacattttcttaatccagtctatcattgttggacatttgggttggttccaagtctttgctattgtgaatactgatgcaataaacatacatgtgcatgtgtcttcatagcagcatgatttatagtcctttgggtatatacccagtaatgggatggctgggtcaaatggtatttctggttctagatccctgaggaatcgccacactgacttccacaatggttgaactagtttacagtcccaccaacagtgtaaaagtgttcctatttctccacatcctctccagcacctgttgtttcctgactttttaatgattgccattctaactgatgtgagatggtatctcactgtggttttggtttgcatttctctgatggccagtgatgatgagcattttttcatgtgtcttttggctgcataaatgtcttcttttgagaagtgtctgttcatatcctttgcccactttttaatggggttgtttgtttttttcttctaaatttgtttgagttcattatagattctggatattagccctttgtcagatgagtaggttgcgaaaattttctcccattttgtaggttgcctgttcactctgatggtagtttcttttgctgtgcagaagctctttagtctaattagatcccatttgtcaattttggcttttgttgccattgcttttggtgttttagacatgaagcccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcagatttgtcaaaggtcagatagttgtagatatgtggcgtaatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttctttgtatcctcttttatttcattgagcagtggtttgtagttctccttgaagaggtccttcacgtcccttgtaagttggattcctaagtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttcggctgagacaatggggttttaattatcgtattttaaatagagatggggtttcacaatgttggccaggcgatggtgtcaaactcctgacctcaagtgatctgcctacctcagcctcccaaagtgctgggattacaggcatgagccaccaggcccagccaacttttttttttttttttttttttttgagacagagttttgctcatattgcccagtctggagtacagtggcgagatctcagctcactgccacttctgcctcccgggttcaagcaattctcctgcctcagcctcccaaatagctgggattacaggcatgcaccatcatgcctggctaatttttgtatttttagtagagatggggtttcaccatgttggtcaggctggtctccaactcctgacctcaggtgatccacctgcctcagcctccgaaagtgcttggattacaagcgtgatccactgtgcccagacttttcattaatttatttatttttgagatggagtttggctctcattgcccaggctggagtgcaatggtgcgatctcttctcactgcaacctccacctccccagttcaaactattctcctgcctcagcctcccaagtagctggattacagacatgcgccaccacacctggctatttttttttttgagatggagttttgctcttgtcacccaggatggagtgcaatagcgtgatctcagctcactgcaacctccacctcccgggttcaagtgattctcctacctcagcctccctagtagttgggattacaggtgcctgccaccaagcctggctaatttaaaattttttttttttatttttagtagagatgaggttttgtcacgttggccaggctggtcttgaactcccgacctcaggtgatccacctgcctcggtctcccaagtgctgggattacagccatgagccactgcatccagcctttcagccttttttttttttcgagatagggtctcaactctagtctcccaggctagagtgtagttgcatgaacacggctcattacagccttgacctcctgggctcaagtgatcctcccacctcagcctcctgagtaactgggaccacaggcacctaccaccaggcccaactaatttttgtatgttttgtagatgcgcccaccaccacacccaactaatttttgtatgttttgtagagatggtttttgccatattgcctaggctggtcttgaactcctgagctcaagcaatcagcctgcctcagcctcccaaagtgctagaattacaggcatgagccaccgggccagctgcaactattctattaatccgaaattatttcaagacataatttaaaatggaaaaaccggctgggcgcggtggctcacacctgtaatcccaacactttgggaggccgaggtgggtggatcacttgagaccaggagtttgagaccagccagggcaacgtggtgaaaccccctctctactaaagatacaaaaattagtcgggctcggtggcacacacctgtagtcccagctgctcgggacgctgagacacaagaattgcttgaatctgggggacagagattgcagtgagctgggatcgcaccactgcactccagcctgggtgacagagcgagacttcatctcaaaaaaaaaaaaaaagaagaaaaatagaaaaatgaaaatgaaaccaaatctgtaccctagatgcgcttattgctcattgctagagatatatctgtttgtaggccctctcagtgaacagacaggggacacatacacagacatgcacactagttctctttataacataactctctttctctgtctatatataaaaccatgagatcatcctgatacctccaattccaattcaacacttcagggtaaacttttgttttccccatccatatttgtcactcttttagtaagtaatctaactcccattattcctaattacttgtttcctcaaacctagattacacaaaggaattttcagaattgcctaacccacaccactacaaaagcaaatctacttaccagagtacaatatttgtttacagatatatatatatatttttttaagagacagcgtcttgctctgtcacccagggtggagtgcagtgtggaacgatctcagctcactgcaacttccacctcctgggttcaagcaattctcatacttcagcctcccagacctttttttttttttttctttaagacagggtctcactttgtcacccaggctggagtgcagtggtgtgatcacagctgaccgcagcctcaaactcttgggctcaagcgatcctcccacctcagcctcttatgtagtggggactacaggtacatgccaccacgcctggctaattttaaaaaaaatatttttttgtggccgggggcggtggcgcacgcctgtaatcccagcactttgggaggccaaggcgggcggatcacgaggtcaggagatcgagaccatcctggccaacacggtgaaaccccgtctctactaaaaatacaaaaaattagctgggattggtggcacgtgcctgtagtcccagctacttgggaggctgaagcaagagaatcgcttgaacctgggaggtggaggttgcagtgagccgagatcgcaccactgcactacagcctgggcgacagagtgagactccatctcaaaaaaaaaaaaaatttgtaggccgggcatggtggctcacaccttaatcccagcactttgggaggctgaggtgggcagatcacctgaggtcaagagttcgagaccagcctggccaacgtggtgaaaccccatctctacttaaaatacagaaattagctgggcatggtggcgggcgcctgtaatcccagctactcaggaggctgaggcaggagaatcgcttgaagccaggaggcagaggttgcagtgagccaagattgcgtcattgcactccagcctgggcaacaagagccagactctcaaaaaatatatagatagatagatagatatgtatatatatatacacacactatatatacacatacatatatatatatacacacacatacatatatatacacacacatatatatatagtagagacagggaccttactatgttccccagggttgtctccaactcctggcctgaagcaatcctcctgtctcagcctcccaaagtgcccagattgcaggtgggagccagcatacccaacccattgtttacaggcatttttcttttttttttctttttttttttttttttgagacagagtcttgctctgtcgcctaggctggctggagtgcagtggcgcaatctcggctcactgcaagctccgcctcctgggttcacgccattctcctgcctcagcctcccgagtagctgggactacaggcgcctgccaccacgcccggctaattttttgtattttttttagtagagacggggtttcaccgtgttggccaggatggtctcgatctcctgacctcgtgatccgcccgcctcggcctcccaaagtgctgggattacaggcgtgagccaccgcgcccagcctgtttacaggcatttttgaggtaaaatttacatgtggtaaaattcacaaatcaaaattcacagcagcctgataaagaatacacttggccgggtgtggtggttcgcgtctgtaatcccagcactttgggaggccgaggctggcggatcacgaggtcagatcgagaccatcctggctaacatggtgaaaccccatctctactaaaaaaaaatacaaaacattagccgggcgtggtggcggctgcccatagtcccagctacttgggaggctgaggcaggagaatggcgtgaacctgggaggcagagcttgcagtgagccgagatcgcgccactgcactccagcctgggtgacagagtgagactccgtctctaaaaaaaaaaaaaaaaaaagaatacactcaagtagctcctacccctatcatgatatagaatgtttacatcagcagggcgcgggggctcacacttgtaatcccagcactttgggagtccaaggcgggcagattacgaggtctggaattcaagactagcctgggcaacacactgaaacaccgtctctactaaaaatacaaaaattagctgggtgtgctggcgggtgcctgtaatcccagctactcgggaggctgaggcaggagaatcgcttgaacccaggaggtggaggttgcagtaagctgagatcgcgtcactgcactccagcctgggcgacagagctagactctgtctcaaaaaaaaaaaaaaagaatgtttacatcaccccagttctttcccagctgttctcagtcaatcctctcccctatgaggcaatgagtgttaaaacttcagggatcctgtaataccagcactttgggaggccgaggcgggtggattgcttgaggccagatgttggagactagcctggccaacatggcgaaaccccatctctactaaaaatacaaaaattagctgggcgtggtggcatgcgactgcagtcccagctactcaggaggcagaggcacaagaattgcttgaacccggtaggtggaggtagcagtgagcagaagtcacaccactgcactccagcctgggcgacagagcgagactccatttccacaaaaaaaaaaaaaaaaaaagaaaaagaaaaaaagaaattgagggcacatggctatccaattgttccaacattatttgttgaaaagaatatccattctgcacttagcacttttttcaaaaatcaattgaacatatatgtgtgggtctatttctggggtttctgttctctttcattgatataattggctgtcttgacacagataccacaatattttgattattgtagctttataataagtcatgaagtcaggaagtgcaggtcctccaaatttgttcttgtttttcaaagttgttttagtttttttacatttccatatgacttttagaaccaggttgtcggccgggtgcggtggctcacgcctgtaatcccagcactttgggaggccgaggcaggcggatcacttgaggtcaggagttcgagaccagcctcaacgtggagaaaccccgtctctactaaaaatacaaaattagctgggcgtggtggtgcatgcctgtaatcccagctactcgggaggctgaggcaggagaattgcttgaacctgggaggcagaggttgcagtgagccgagattgcgccattgcactccagcctgggcaacaagagcgaaactccgtctcaaaaaaaaaaaaagaatcaggttgtcaattctacaaaaatatccgctgggatttgactgggattacattgattctatagatcaacgtcaggagaactggtatcttaataatattgagtctcctgcttcataaacatggtgtgtctattcatttgggaattatttaatttctttctttctttttttattttttttcttttattttttgagacagagtctcactctctcacccaggctggagtacagtggcaccatctcggctcactgcagcctctgcctcccgcattcaagggattctcctgcctcagcctcctgagtagctgggaccacaggctcatgcccccacgcctggctaatttttcgtttgtttgttttttgagacagagtctccctctattgcccaggctagagtgcagcggcacaatctcggctcactgaaacctctgcctcccaggttcaagcgattctctcacctctgcctcctgaatagctgggactacaggcacacaccaccatacctggctagttattttttatttttagtagagacagggtttcaccatattgaccaggctggtctccaactcctgatctcgtgatccatccacctcagcctcccaaagtgctaggattacaggcatgagccactgcacttggcctttttttttttttttttttttgagatggagttttgttctgttgccttggctggagtgcagtgacgccatcttggcttactgcaacctcttcctccggggttcaagcgagatggggtttcaccatgttggccaggctggtcttgaactcctgacctctggtgatccacctgccttggcctcccgaagtgttaggattacaggtgtgagccacccctcctggcctaatttttgcatttttagtggaaatgggggtttcactgtgttggccaggctggtctcaaactcccgaccccaagtgatccatctgcctgggcctcccaaaatgctgggattacaggcgtgagccaccatgcccagcccatacatgttattttaaggtttcaatttcctatgggtcactgctagtttatagaaatacaattagctgggtgcagtggctcgcgccagtaatcccagcactttgggaggctgaggcaggtggatcacttgaggccaggagttagaaaccagcccgggcaacatggtgaaacctcatctctacaaaatatacaaaaattagcaaggcatggttgcgtgcgcctgtaagtcccagctactcaggaggcttaggtgggaggaatgcttgagcccagaagacggaggttgcagtgagccaagagccagaccctgtctcaaaaagaaaaaaaaaaaagaaaaaaaagagccgggcacggtggctcacgcctgttatcccagcactttgggaggctgagatgggtggatcacctgaggtcaggaattcgagaccagcctggccaacatggtgaaaccccatctctactaagaaaatacaaaaattagtcgggcatggtgacgggcgcctgtaatgccagctatttgggaggctgaggcaggagaatcacttgaacctgggaggcagagagctgagatcgcgccattgcactccagtctgggccaccacagagtgagactccgtctcaaaaaaaaaaaaaaaaaaaaaaaaaggacatgttggcctgtttgtaatgttatgttaggaggaaaggcagtctttcaccattgagtttgacattactataggttatttgtaattgctctttatcatatggaggagatattaccttctttcatttctagttttctgagaggtttttttggtttttggtttttggttttttttctgagacagagttttgctcttcttgcccaggctggagtgcagtggtccgatctaggctcactgcaacctccacctcccgggttcaagtgatcctcctgcctcatcctcctgaatagctgggattacaggtgcacgccaccacgtccagctaattttttgtatttttagtagaggtggggtttcatcatgttggctaggctggtctcaaactcctaacctcaggtgatccacccgccttggcctcccaaagtgcagggattacaggcgtgagccaccatgcccagcccatacatgttattttaaggtttcaatttcctatgggtcactgctagtttatagaaatacaattagctgggtgcagtggctcgcgccagtaatcccagcactttgggaggctgaggcaggtggatcacttgaggccaggagttagaaaccagcccgggcaacatggtgaaacctcatctctacaaaatatacaaaaattagcaaggcatggttgcgtgcgcctgtaagtcccagctactcaggaggcttaggtgggaggaatgcttgagcccagaagacggaggttgcagtgagccaagagccagaccctgtctcaaaaagaaaaaaaaaaaagaaaaaaaagagccgggcacggtggctcacgcctgttatcccagcactttgggaggctgagatgggtggatcacctgaggtcaggaattcgagaccagcctggccaacatggtgaaaccccatctctactaagaaaatacaaaaattagtcgggcatggtgacgggcgcctgtaatgccagctatttgggaggctgaggcaggagaatcacttgaacctgggaggcagagagctgagatcgcgccattgcactccagtctgggccaccacagagtgagactctgtctcaaaaaaaaaaaaaaaaaaaaaaaaaaggacatgttggcctgtttgtaatgttatgttaggaggaaaggcagtctttcaccattgagtttgacattactataggttatttgtaattgctctttatcatatggaggagatattaccttctttcatttctagttttctgagaggtttttttggtttttggtttttggttttttttctgagacagagttttgctcttcttgcccaggctggagtgcagtggtccgatctaggctcactgcaacctccacctcccgggttcaagtgatcctcctgcctcatcctcctgaatagctgggattacaggtgcacgccaccacgtccagctaattttttgtatttttagtagaggtggggtttcatcatgttggctaggctggtctcaaactcctaacctcaggtgatccacccgccttggcctcccaaagtgcagggattacaggcgtgagccactgcacccggccaagagttttttttaaatcaggaatggatggtggattttgtcaaatgcttttctttgcatctcttgagatggtttttcttgcattcttggaataaattcaaattcaacttgatgtattttcttttgtatatattgttggatttgatttactaaaatgggctgggcacgtggcttacgcctgtaatcctagcacttttggaggtagaggcgggtggatcatctgagatcaggagttcaagaccagcctggccaacatggtgaaaccccgtctctactaaaaatacaaaaattagctgggcgtggtggcatatgcctgcaatcccagctactagggaggctgaggcaggagaatcgcttgaacccaggaggcagaggttgcagtgagccaagtttgcgccactgcacttcagcctgggcagcagagtgagcctctgtctccaaaagaagaagaaaaaaaaaagcaaaaaaacaagatttactaaaatgttaagaacttttgcatctgtgttcatgaaggatagttacatatagctttcttttcttgtaatgactttctgtggttttgtatcagagtaatgctagtttcatagaatgagttggaaagtatcccctcctcttaaattttctggaagagtttgtgcagaattcatattatttcttctatatatatatggtacagttccccaaggaagccatctgggcctggaatttccttcaggggaatgtgttttactacaaattcaatttatttaatatatatagggctagtcaagttatctatttcttcctgagtgggcattggtattttgtgtcttgcaaggaatttgttgtgagaagtatgggcataaatttgtttgtaatattctcctttatccttttttaaaattgaggtaaaatgtgcatgacataaaatttatcgttttaaccatctgtaagtgtacaattcaggagcattaagtacattcacagtgttgtgtaaccaacgccactgtctatttccagaactttttcatcatcccaaacagaaactctgtacccattaagcaataactctccattttccccatccccaaggccctggtaacctctattctactttcttcctctagtaacttgcctattctaaataccacatataagtggaatcaatatttgtcctgtgtctggcaaatttcacttagcgtattttcaaggttcatcctgaattggccttctccatctccaggcagtaagctgggcaaccatcatgcttaccttgtttgtttcccatctctcagggatcactttccttcattgtctaatgtccagtatctttttgttgttgttctgtttttgagacagggtctcactctcacccaggatggagtgcagtggcgcaatcacgggtcactgcagccttgacctcctgggctcaagcaatcctaccgcctcagccttccaaatagctgaggcttccagattagccaccacactcagctaatctgatgtccactatcgtgagatttgtttttccattttactcatctggatttttgtttgtttcaggcaggagggcaaattctgtccccattattccatcttggttgaaaattgggctgggcgcggtgactcacacctgtaatcccagcactttgggaggccaaggcaggtggatctcctgaggtcaggagttcgagaccagcctgcccaacatggtgaaaccccatctctacaaaaatacaaaaaattagccgggcatgatggtgggtgcctgtaatcccagctactcaggaggccgaggtgggagaattgcttgaacccaggaggtggaggttgcagtgagccgagaacgagccattgcactccagcctgggtgacagagtgagactctgtctcaaaaaaaaaaaaatgaaaaccaataattacaaatgcagaaaatcatgcaccaggtttccagacaaatttggtgaaagataagtagaacaaaatagttttttaaataaaaagaatgtaataacagtgaactatttatcagttttttttgttttttttgtttgtttgtctcaaagagctcccggccgggcgcggtggttcatgcccgtaatcccagcactttgggaggccgaggcgggcagattacctgaggtcaggagttcaagaccaccatggagaacatggtgaaacctcgtctctactaaaaatacaaaaattagctgggcgtggttgcacacgcctgtaatcccagctactcgggaggctgaggcaggagaattgcttgagcctgggagacggaggttgcagtgagccgagattgtaccactgcactccagcctggccaacagagcgagactgtctcaaaaaaaaaaaaagaaagaaaaaagaaaaaaaaagaagggaaggaaggaaggaaggaaggaaggaaggaaggaaggaaggaaggaaggaattcagtgccaggcacggtggctcacacctgtaatcctagaactttgggaggccgaggcgggtggatcacctgaggtaaggagttcaagaccagcctggccaacatggtgaaaccccatctttactaaaaatacaaaaattagctgggcggcctggcacaatggctcacgcctataattccagcactttggggggcccaagccggtggatcatgaggtcaggagattgagaccatcctggctcgattctcctgcttcagcctcccgagtagctgggactacaggcgcatgccaccacaccagctaatttttgtatttttcttagagacatggttttaccatgttggccaggatggtctcgatctcttgaccttgtgatctgcctgcctcggcctcccaaagtgctgggattacaggtgtgagccactgcacccggccgttttttgttttttgttttttgtttttgagacagagtctcgctctgtcaccaaggctggagtgcagtggtgcgatcttggctcactgcaacctctgcctcccaggttcaagcagttctcctgtctcagcctcccaagtagctgggactacaggcatgtgccaccacgcttagctaacttttgtgtttttagtagagacggggtttcgccgtgttggccagcctggtcctgaactcctgacctcaagtgatctgccctcctcggactcctaaagtgctgggattataagcgtgagccactgcgcttggcctatactcttcattagaagcaagtctctaagtccaactcacattcaagaggaggaggggaattaggttccaccttttgaggggatgagaataagatatctaatacatattttggaggtgataattttttttttttgagaccgagtctcgctctgtcacccaggctggagtgcagtggcgctatctcggctcactgcaagctccgcctcccgagttcacaccattctcctgcctcagcctcccgagtagctgggactacaggcgcctgccaccactcccggctaatttttttaaaattttttttagtagagacgggttttcaccttgttagccaggatgttcttgatctcctgaccttgtgatccgcctgcctcagcctcccaaagtgctgggattatagccatgagacaccgcgcctggcctatactttttaaaaataatatattttttggctgagcacggtggctcacgcctgtaatcccaacacattgggaggctgaggcgggtggatcacttgaggtcaggagttcaagaccagcctggccaatatggtgaaaccccatgccgggtgtggtggcacgtgcctgtaatcccagctactcgagaggctgaggcagaactgcttgaacccaggaggtggaggttgcagtgagctgagattgcgccactgcactccagcctgggcaacagagcgaggctctgtctcaaaataaaaataaaaattaaaaaaatatatattttttgacatggggtttcaccatgttgcttaggctggtctggaactcctcagcttaagcgatcctcccacctcagccttttgttgggattacaggcgtgagctgctgtgcccagcctgaaggtgatactttaaggatgtgcaactgtgtttcaccttaaagttttgcccactagttttagcatttaatggatcttgtctgcagcaattattactgtggtattctaatgggaattttctacttccctcattccttctatatatattatttggaattcttgtgtaagaaagagttgacccttctccaccattcatgtatttattagagacagcatctcccagtgtcatccaggctagagttcaggggctattcacaggagtgatcatggtgcattacagcctcaaactcttgagctcaagccattctcctgcctcagcctcccaagtatctgggactacaggcacacaccacctcgtctggctctcagcatttatttattcaatcatatcacttatataaataagtatggaatcatggatgttcattttttgaactataatctaatattaccctttctgttattcttgctcaaattgttccagctttggccattgggagttgtttttcttttttttcgagacggagtctcactctgttgccaggctggagtgcagtggcgagatctcggctcactgcaacctccgcctcccacgttgaagcagttctcctgcctcagcctccccagtagctagaactacaggcgcgtgccaccacacccagctaatttgtgtatatttagtagaggcggggtttcaccatgttggccaggatggtcttgatctcttgacctcatgatccacccaccttggcctcccaaagtgctgggattacagacgtgagccaccgcacctgaccaggagttctttcaggttggcttctgtatcttatgacatgctgcaatcattgcttttttgtttgttttttttttttttttttttttttttttttgagatggagtttcgctcttgttgcccaggctggagtgcaatggcatgatctcggctcactgcaacctctgcctcccaggttcaagcaattctcctgcctcagcctcctgagtagctgggattacaggtgccccccaccacacccagctaattttttgtatttttagtagagacggggtttcaccatgttggccaggctggtctgaaactcctgaccccacgtgatccatgcgtcttggcctcccaaagtgctgggattacaggtgtgagccaccgtgcctagcctccatcattggttttaggcatttccttactttctgtcactacaggatgctccaggctcatcttgtatttctctccaccccagactgaaaatcagccatttttccaggagcactggtttcttttattggagaatggcatttagaaaccaaggtccaggccaggcgcggtggctcagacctgtaatcccagcactttgcgaggccaagatgggcagatcacctgaggtcaagagttcaagaccagcctggccaacacggcgaaaccctgtctctactaaaaatacaaaaagtagtcaggcgtggtgggcagcgcctgtagtcccagctactcaggaggctgaggcaggagaatcgcttgaacccaggaggtggaggttgcagtgagccaagattgcgccattgcactccagcctgggtgacaagggtgaaactctgtctcaacaacaacaacaaaaaagaaaccaagatctggccactagatgtgctcattgtttctgggatagcatgatttgtaggacttctcagtagacagactgagaaaccgtctgcaaaaaccaagaagataggaccacttagtacaacatagtatctatggtaggtgccttctgagatgccctcaaccagtgctccctgcctgctatattcttggtcttgtgtaatcccctcccctttagtaacttctttgcaagtaacagaatgcctcaaccttgaggggatatcacttccataattagatcacaagagatgtgacctctgttttgctagccaactctttctctcgctggcttggatgaagcaaactaccatgctgtgagccactgcatggaaaggcacacatggtgtggatggtgggcacctctggctaacagccagcaaggaactggggccctctgtccaacaggctgcagagaaccggatcctgccaacaaatatgggagcacagagcagatccttccccggtcgcacgttcagagaagtcctcaatcctgcccaactccttcctcgattgtgccttagtgagagaggctgaagctgaggacccagctgaacccagcctggattcctgacttgcaaaacctgagagataatttatgtgtattgtttggagccactaagattgtggtcatttgtttcacaggaataagtagtacggcatacttacttggatcctagcacagaaaagacgttagtggaaaagccagtgaaatccaaataaagtctgaagttgagttaatagtactctaccaatcttatttttttttttattttttattttttttgagatggagtctcgctctatcgcccaggctggagtgcagtggcgcaatctcggctcactgccagcctcctgggttcatgccattctcctgccttagcctcccgagtagctgggactacaggtgctcgccaccacacccagctaattttttatatttttagtagagacggggtttcaccgtgttagccaggacggttttgatctcctgaccttgtgatccgcctgcctcagcctgccaaagtgctgggattacaggcgtgagccgccacgcccggcccaatgttattttcttagcactgataaatgtgccatggttacgtagaatgttaacattagggggaggtgggtgacaggtatgaaagctcactaatggtgatgcaactcttctgtaaatctaaaattatttcagaaaaactgttaaaaaacctctgggaggccaggtacggtggctcacgcctgtaatcccagcactttgggaggctgaggcgggtggatcacaaggtcaggagatcaagaccatcctggctaacgtggtgaaaccccatctctactaaaaatacaaaaaaattagccgggcgtggtggtgtgcgcctgtagtcccagctacttgggaggctagggcaggagaatggcttgaacccaggagccggaggttgcaatgagccaagatcccaccattgcactccagcctgggcgacagagtgagacttcgcctcaaacaaaaacaaaaacaaaaacaaaaacaaaaaaacacacctctgggaggccaggtgcagtggctcacacctgtaatcccagcactttgggaggccgaggcagttggatcatttgagatcaggagttcaaaaccagcctggccaacatggtgaaaacccatctctactaaaaatacaaaaattagccgggcagtagtggcatgtgtctgtaatcccagctactcgggaggctgaggcaggagaatcgcttgaacctgggagttggaagttgtggtgagccaagatcatgccactgcactccagtctgggtgacagtgagaccctgtacccccttcccccccaaaaaaaaaacctctgggcattacatgttacgtttaaaaaataaagaagaggccaggcacggtggctcatgcctgtaatcccaacaatttgggaggccgaggcgggcgaatcatctgaggtcacgaatgcgagaccagcctgaccaacatggtgaaaccttggtctctgctaaaagtacaaaagattgggccaggggccgtggctcatgtctgtaatcccagcaatttgggaggccaaggcaggcggatcatttgaagtcaggagttcaagaccagcctggccaacatggtgaaaccccatctctactaaaaatacaaaaattagctgagcagtagtggcacatgtctgtaatcccagctactcgcaaggctgaggcaggagaatcacttgaacctgggaggcagaggttgcagtgagccgagatcgcaccattgcactccagcctggacgacagagcgagactctgtctttaaaaaaaaaaaaaaaaggccgggcacagtagctcacccctgtaattccagcactctgggaggccgaagtgggcgatcacgaggtcaggagtttgagaccagcctgaccaacatggtgaaatcctgtctctaataaaaatacaaaaattagccaggcgcggtgacaggtgcctgtaatcccagctactcgggaggctgaggcaggagaattgcttgagcctgggaggtggaggttgcagtgagccgagaccgtgccactgcactccagcttgggcaaaagagcgagactccatataaaaaaaaagaaaagtacctaaaatttgccaggcgtggtggcacatgcctgtaatcccaggtactcaggaggctgaggcaggagaatcgcttgaacccgggaggcggaggttgcagtgagctgagatcgcgccattgcaccccagcctgggtgacagagggaaaccctgtttcaaaataaataaataaataaataaaataaaataaaataaaataaaataagagagtatagggccaggtatggtggtttacgcctgtaatcccactttgggaggccacggcaggtatatcacttgaggccaggagtttgagactagcctgggcaacatggtgagaccctgtctctactaaaaatacaaaaattagctgggcgtggttgcgcgtctgtaatcccaggtacttgggaggctgaggcacgtgaatcgcttgaacctgggaggcagaggttgcagttagcagagatcatgccactgcactccagtctgggcaatagagtgagactccgtttcaaaaaaaaaaaaaaaaaaaaaaagagagagagtacagcaaagttgaggagaaaaaataaaggttattagggagccatcagtctggttacagagattcagcaaccaggcttggaggggtagcagtgtgataggttagaaagagctagcaagggtcgggtgtggtggcttacacctctaatcccagcactttgggaggccgaggcaggcagatcacttgaggtcaggagttcgaaaccagcctggccatcatggtgaaaccccgtctctactaaaaacacaaaaaattagctgggtgtggtggcagatgcctgtaatcgcaactagagaggttgagacaagataattacctgaacctgggaggcagaggttgcagtgagccgagatcatgccactgcactccagcctgggtgacagggcgagattgtctcaaaaaaaaaaaaaagagataacaagtatggtggtcacagtctagggtagtcacggtgaccaagcccagttccagccctcagaggtcacagtctggtgggggaaatggagggaccaggcctgatgcttgttctaggagtcagtgtctggttgagaaattgcgggaaaatactttttcccagccttcaagaagatacttgtgttcatttaaattctcccaaaatctcaacatctgttccaaaattcagttggttgcttgttcctctgcctttcagatatttgtctttgtcctttccaccatcttaaatacctctgttgtctgccaggaaatatcctcatagacttctttatcagtttcaaaagtggatttgcaagaaaagcttctttccccctctgccctcagtggcatttttcaatcgagccctcactcacctgactttactgttttaccgcctcacccatttacaggcttgcatatcttcagaacagttcaattctattcctcagcttcttcaaagaccaaatggaagtaagaagcagcatgttctgactaacatccctttagagaaataaattagatgaaacacttgcagcagttaaaattgtgcctggtgattggtctttaaaaatactgtcttttgtttgcatattgtcttcctccatgccctcttcctttctaaattcttttatccatccttctggaatctgtttctcccaaggacttttatccctcttggcctgcatgggctatgttcactgcacagtgtaaaacaaggacaggagactctttgccaaagttaaaagcgcatcaaacacgcctagcttttattattttaatcacaaacctatagacccctcagtataccctccatggggcctggccccagcaatccaaagctgacaaccttgggtgtaggtatgaggggtgggaatggaggggggagtgtctcttgataactctgaaatggggtgattcctccaaatgaagaactgggtggggaacagaggttggggtggcctagattctcagtatgcggagcaataaaaaaatcagataaacaaatgagggggtacaatatgcttttacaaccctcctccaagcttctgccttgctgggggaaggcttccagtttttcctgggctggggaggtcccaggatagccccttccttcatcctcttgccctacatgttgaaaaagaatactgaggtactggttctggtaacctgaactcagtcccccactaatacccatcaccttcccaaactgcccctcaaggaagaaggcaggactctgcccaagggtgggggcctctcactccagatataggtctggaaaattcatccatgaaatttcataatctgtccccttccccaagagcaaggttggctcagagccctcctaggttaggtcaggttggtcccaggttaaggcaggggagcttaagtaccactcctccctgcagtgtggaatgcttagatgggatgttgctgagggacaagggtggggctgtgatctccacaagcactagcggtggcctggtcctactgattctttcacacctgaaatacctgtgctgggctgttcctatagggaaggggtggggcctggctcctccattcctagaaggccaggagagttcccaggggaaggggctgggtctcatcctcacttctgttccttgcctgggcagagcagggcagggttcatggggaaggggcagagcttaaacccccagggctgggacctccattacttgactcctcttctgtgccaggacggactagactggtggttccaagacaaaggatggagcaacatcctgacatctccctttcccaggagacctggctaggacagtccctaggggacagggtcgagacctcatcctgtctccttccctcacctgggcaaggatgagtcccacaggggcaggggtgaggctgtgatccccagggggcaggccctgatctcatgtccttctccagccttctccttctgaaatacctgcactgggcggttcctttggggaaggtgcagggcctcatctgactcctcctccttgcctgattacaggggtggggcctgatcacatctcctcttcccccaggatacctgggcagggcagtctcatgggagggtgggggaaaaggcggggcctcatcctgactggtcctcctttcctgggtgggaaagtcccaggggaggggtgaggcctgatcaggactcctcttccatgctgaagctgctgcggcggctgctggccttggagacagcaggggacactgaagagagcaggggatcggaggcagcccgcagtggggacagggcaccccccgacagtcctcccaccaccccctcctcctcctccatcagaatgtcctccagccccaggtggaaggggtctcccaggtcccccaggtggtcgctgggaaagtgcaggtccagaagggcatctgagggcggtgcagggggctgctgatggggagcattctgggcaggtcccccccctacatggaacgttgctgcgcctggcctgccctcctcctcaatgtccagctgctctggcttgaggctgtcagaagccgaagtcgtggccaaggaaagcagccctggagtgggaggtactggcaggccatggatctgggcctgcagttctagttcctgtaaaaaataggggttgggtgcaggataagtagggttcagagtccctcagaggcagaggagtataaaggttgaaaagggtaggttccctgggttggaattcagcttctgctactcactagttccaaaactttaggcaaggtgcttaacatctctgaagcttcagagtcgcaaactgtaaagtgggtatataataatggcccctaggctgggcgcggtggctcacgcctgtaatcactttgggaggccgaggcaggtggatcacctgaggtcaggagttcgagaccagcttgaccaacatggagaaaccccatctctactaaaaatacaaaaattagctgggtgtggtggtgcatgcctataatcctagctactcaggaggctgagacaggagaattgcttgaacccgggaggcggaggttgcggtgagccgagattgcgccattgcactccagcctgggcaacgagcgaaactccatctcaaaaataaataaataaataaataaataaaataatggcccctatctcatagaattctgaggattgaataagttagtggatataaagctcttgtcacagtacagagcacaagataaatgctatgtacattagcaatattattatccttgttaaccaagggtgggggcctctcactccagatataggtctggaaaattcatccatgaaatttcataatctgtccccttccccaagagcaaggttggctcagagccctcctaggttaggtcaggttggtcccaggttaaggcaggggagcttaagtaccactcctccctgcagtgtggaatgcttagatgggatgttgctgagggacaagggtggggctgtgatctccacaagcactagcggtggcctggtcctactgattctttcacacctgaaatacctgtgctgggctgttcctatagggaaggggtggggcctggctcctccattcctagaaggccaggagagttcccaggggaaggggctgggtctcatcctcacttctgttccttgcctgggcagagcagggcagggttcatggggaaggggcagagcttaaacccccagggctgggacctccattacttgactcctcttctgtgccaggacggactagactggtggttccaagacaaaggatggagcaacatcctgacatctccctttcccaggagacctggctaggacagtccctaggggacagggtcgagacctcatcctgtctccttccctcacctgggcaaggatgagtcccacaggggcaggggtgaggctgtgatccccagggggcaggccctgatctcatgtccttctccagccttctccttctgaaatacctgcactgggcggttcctttggggaaggtgcagggcctcatctgactcctcctccttgcctgattacaggggtggggcctgatcacatctcctcttcccccaggatacctgggcagggcagtctcatgggagggtgggggaaaaggcggggcctcatcctgactggtcctcctttcctgggtgggaaagtcccaggggaggggtgaggcctgatcaggactcctcttccatgctgaagctgctgcggcggctgctggccttggagacagcaggggacactgaagagagcaggggatcggaggcagcccgcagtggggacagggcaccccccgacagtcctcccaccaccccctcctcctcctccatcagaatgtcctccagccccaggtggaaggggtctcccaggtcccccaggtggtcgctgggaaagtgcaggtccagaagggcatctgagggcggtgcagggggctgctgatggggagcattctgggcaggtcccccccctacatggaacgttgctgcgcctggcctgccctcctcctcaatgtccagctgctctggcttgaggctgtcagaagccgaagtcgtggccaaggaaagcagccctggagtgggaggcactggcaggccatggatctgggcctgcagttctagttcctgtaaaaaataggggttgggtgcaggataagtagggttcagagtccctcagaggcagaggagtataaaggttgaaaagggtaggttccctgggttggaattcagcttctgctactcactagttccaaaactttaggcaaggtgcttaacatctctgaagcttcagagtcgcaaactgtaaagtgggtatataataatggcccctaggctgggcgcggtggctcacgcctgtaatcactttgggaggccgaggcaggtggatcacctgaggtcaggagttcgagaccagcttgaccaacatggagaaaccccatctctactaaaaatacaaaaattagctgggtgtggtggtgcatgcctataatcctagctactcaggaggctgagacaggagaattgcttgaacccgggaggcggaggttgcggtgagccgagattgcgccattgcactccagcctgggcaacgagcgaaactccatctcaaaaataaataaataaataaataaataaaataatggcccctatctcatagaattctgaggattgaataagttagtggatataaagctcttgtcacagtacagagcacaagataaatgctatgtacattagcaatattattatccttgttaatattatgattattatttatcattatcactatcatcatcgtgtgatctgggaagcccagggatcccccaagtatgccaggaagggaaaccctggcctgctctctctctgcctccacctgcaggaagctctccccctcttcccccaccaccatctcctcttttcaaacctgaattcggagctgcaggctgcggttggcctgctccagggatcgctgccggctctccaggtctttggagcgctgctgctccttctgcagcttgcggatataatccacagaggccttcaggatggtgcccttgttccagcgcatctccctgtggggcccaagtgggaggcaagcaggaaatgccacatgaggagtttctcaggagctgaggcggggattgcaccaggtgggagcctcccaccacatgcttagaacttgaggctggggtctttcaaaggtatggagtatccagaggaaaacttcccgcctggaatcttacaatggtgccccatcacactccaaaccctggaagccgtctctgacctgaccccttaggattcctctcttccctatgtccctccgattgatctcactacagccacattggtctctcagtgctcctagaatatggaaaaccactcccatctcagggcatcaatcccagccgtgccctctgccttgaatactcttacccccagacacccatgcggctccccgccttgcctccttaggctctttattcaaacgtttccttgtcagttggggcctgccctgtcctcaccttccttatcccaaactaaccctccccaacattctcccattttccttccagtctttattcttctcataacactcatcataatggatctcatggatgtttacttatttactatttgtctgcccccactaaaacatcagtttcatgaggtctgttttgttccctctggtatctttagggcctaatatggtacctggcacaaaccagaggttcaaaaaataaatctttctcttttcctttttttttgcggggcggtgggggatggagtctcgctctgtcacccaggctggagagcagtggcacaatctcggctcactacaacctccacttcttgggttcaagcgattctcctgcctcagccttctgagtagctgagatgacaggcctacgccaccacgcccagctaattttttttgtattttttgtagagatggggtttcaccatgttggccaggctggtctcaaactcctgacctcaggtgatccacccgtctcggcctccccaagtgctgggattacaggtgcccaccaccacgccccgctaatttttatatttttaatagaaatggggtttcaccatgttggccagaatggtctcaatctcctgaccttgtgatccacccgcctcagcctcccaaagtgctgggattacaggcgtgagccactgcgcccggccatctttttttttttttgtttttgagacaaagtcttgctctgtcacccaggctggagtgcagtggcaccatattggctcactgcaacctccacctcccgggttcaagtgattctcctgcctcagcatcccgagtagcggggattacaggtgcgtgccaccacgcccagctaaattttttttatttttagtggagacagggtttcaccatgttggccttcacctcctgacctcgtgatccgcctgccttggcctcccaaagtgccaggattacaagtgtgagccactgcacctggctaatttttgtattttttagtagagacggggtttcatcatgttggccaggctagtctgaaactcctgaccttaggtgatcgaccccgccttggcctcccaaagtgctgggattacaggcatgagccaccacacccggccaataaataaatcttgaataaataaaggaagtaccattgcaccactgcactccagcctgggtgacagcgtgagactccatctcaaaaaaaagaaaaaaaaaaaggaagtactaagtgaacagaaaagtaggtgcatatatcctacggggaccagatggggcacacagaccataacattatgtgcctaaaattttaggtgctgacatagtgagggtctgcaaccctgctcaggctgagaaagaaccagacagaggagaaatgcctgggccgagactgcctggtgagcccaccaaggcacaattttagtagcatgggacgcctgccccacctcccgctggcctgagggtcccagcccagactcacgggtcactggacttagggatgagagtgcccagttccttgatcctgtcgttaatgttgaatcgcctgcgacgctcaactttggagaggggaggagaggaagaaagagtgggagaaagagttgtcaattagccaaaaatggaagagacagaaagtagggagttgggaggctgttgcagggaaggagttccccatggggggccaggactcggggtgaggcaggcctgcacagcacccgggcaatgcacacgctctctggcttacttaggttgtgattgtctttcttctgccgttccttcaaaagggcctttgcctcggtctctggaaaagagtggagtgatcagggcctctgagcacaggaaggcaagaaacacatgcagatactaaggtagggtttggtagccaaaagcaggggaaatgccttttttaaaaagtgccttctttttactattttaagccatggtgataggctggttgttaaatccaagacgagaggaactgaagtggggtgaaagcaagaccacaagccatagggggaaaggggacaaacagcctccatttccatatgtccaaaccattcccctcagaatcaggcccatctctagacctggtaggcacagggctcacctggggtaaagtgtagggccatggggccaagaccctatcacctaccagagatctcccgtttgatgttgggcagctcagctgggcaggagttgctgacagtgatggctggtgtggccacgccttgactactgtacacatcaagcagattccctgacacaggcagctgggggcagagagggcagagaaccaccagttgggaacaaacccaggcttggctcctcctcagaaccaggttcctgagcttccacatatcccaaagatggggcaccctctaatgcaaggactggctgactcagcaccagaacccttgcttctccttcaaggcaaattcacatggcgaccaaacagggaggacagagcaaactggacctaccttgcttcgctgggagactggagcctgcctggcctgcttatcacttcctccagtccctcatatccctcagtgacctctaaagcccctttcccaaaccccggggctggctctgagaagaaatgctggaaaaccacccttctcaggtctttgtcggctctgatgggacattccagtccgttagctcctcccagcacaacattccaatccagcattcttggaacactccaacccaatcttctccgaccttggtaaattgtcatgacaacattctatccaaaatctggccttctggagaattccaacctaatctccagtctttcactctgatcaagttgtaccatcttccactctgatcaagttgtaccatcttccacatcagggtctcctgctgctgtggaccaaggtcctgactccagtatcttcctgcacattctgttctctcaggagattcttatccaactattcaattagcactgctttatgtcagcctagtttttttttttttcctctccttcacactttcctggatatactccagaggagcacgtcaatcttaagtatacccagggccaggtgcagtggctcacgcctgtaatcccagcactttgggaggccgaggcgggcggatcacttgaggtcaggagttcgtgaccagcctggccaacatggtgaaactccgtctctactaaaaatacaaaacaacaaaaaaaattagccaagcatggtggcctgcacttgtagtcccagctacttgagaggctgaaacaggagagttgcttgaacccaggaggtagaggttgcagtgagccaagatcacaccactgcactccagcctgggcaacagagcaagactctatctcaaaataaataaataaataaataaataaataaataaatacaaataaaataaagtatatccaaatcccacttcttcatgagttttaatctctttttttttttttttttttttttgagacggagtatcgttctgtcacccaggctggagggcagtggcgcaatctcggctcactgcaagctctgcctcccgggttcacgccattctcctgcctcagcctcccgagtagctgggactacaggcacccgccaccacgcccagctaattttttcgtatttttagtagagacggggtttcactgtgttagccaggatggtctggatctcctgaccttgtgatctgcccgcctcagcctcccaaagtgctgggattacaggtgtgagccaccgtgcctggctgagctttaatctcttgaacccacttccagtctggtggatataaggtcccattctctagttgtgtccaaatcaataaaaagttctgataaattagtcccatttttatacatgcttccatcctattgataagttggaaaaaagcaaaactacagccacttggtatgctctaaagcaagttatgagaccaggcatggtggctatgtctgtaatcccagcactttgggaggccgaggtgggcagatggcttgagctcaggagttcgagaccagcctgggcaacacagtgagaccctgtctctactaaaaatgcaaaaaattagccaggcatggtgacacaagcctatggtcccagttacttgggaggctgaggtgggaggatcacttgagcccggaaggtggaggctgcagtgagccaggattacaccactgcactccagcctgggtgacagagcaagatcctgtctcaaaaataaataaataggccgggcgcagtggctcaagcctgtaatccgagaactttgggaggccgaggcaggtggatcacctgaggtcaggagttcgagaccagcctgaccaacatagtgaaaccccgtctctactaaaatacaaaaattagccaggcgtgctggcgggcacctgtaatctcggctacttgggaggctgaggcaggagaattgcttgaacccaggaggcagagggtgcaatgagcagagatcgcaccattgcattccagcctggacaaggagagtgaaactccatctcaaaaaaaaaaaaaaaaattcaataaaaaaaaaaaaataaataaataaagcaagttaggccaggcatggtggctcatgcctgtaatcccagcactttgggaggccgaggcaggcagatcacaaagtcaggagattgagataacctgggtaacacggtgaaaccccgtctctactaaaaatacaaaaattagccgggcatgggggcacgcgcctgtagtcccagttactcaggaggctgaggcaagagaatcgcttgaacttggtaggcggaggttccagtgagccgagatagcaccattgcgctccagcctgggtgacagagcaagactttgtctcaaaaaataaataaataaatataataaagcaagttatgagactcttggagtgttcaaaaccagaatgttacaatggtatatcccttgctctagaaagttttatctactgactagaaggactctgcctcctggcacagttcacttggtatattccaatcactacgagatccaactacttgttataacccacagcaagtttgaaaacttttgttatgcttcaaggccaggtgtggtggctcacacctgtaattccagcactttgggaggccaaggcaggtggatcacttgaagtcaggagttcaagaccagcctggctcacagggtgaaacccggtctctactaaaaatacaaaaattagccaagcgtagtggcgtacacctgtaatcccagctacgtgagaggctgaggcacgaaaatcgcttgaacccagaggctgcagtgagccaagatcgcaccgctgcactccagccagggtgacagagtgagactctgtcttaaaagaaaaaaaaggtaaaaataaaataaaacaaaatgctccaatcattacatggtctggtgtatatgtcccgatgacctgaatcccttggtacattcaagttgctataagatgctcatctcggccgggtgtggtggctcacgcctgtaatcccagtactttgggaggccgaggcaggcagatcacgaagtcaggagttcaagacccgcctgaccaacgtgatgaaaccccgtctctactaaaaatagaaaaattagcttggtatggtggcacgtgcctataatcccagctactcaggaggctgaggtaggagaatcgcttggacctgggaggcagaggttgcagtgagctgagaccgcgccactgcactctagcctgggtgacagagcgagactccgtctcgaaaaaaaaaaaaaaaaaagattatcatctcttggtacttctcacagcaaagcccaagcactttgatatgccctactgtctcagtgaactccccacctgtatctctcacagtctacatggtccacctctcaacacagtccaacaaggtccaaaggcattgttgacataccctgttctcgtcataaggcctccctctctatcttagcacaatcaaggcaagggtctcctatacacacagccagactgagtatggtcttggtgatacagaaatgccctaattttcagaccaacctcccatctcagggcctcaccgtgctggggagctgcagtcctgtggtgcctccgggcagatagctgagcatttcatcattgtaactggactccaggctgatgatctcatcaatgacatcatcaatctaggggaagaagtaaatattatacaggtttagaagaatttgggaggggaatgtgggaggaggtttggctgtagcctcttacctccttctctgagctggacccgatggtgagcagcgccatggggctgttgggcgcactgcctgtggggccggtagtgtgggcagcctcaggggcaggcagtggctgggcacttgcgggccccggcggtggggtgagggcctgggaagccagcttgggcccgagtgtggtggacaggtactgtttcacctgctgccggcgcgcctgctgcaggtggtagcgcgttgggttctccagatgggtctgcacctgtgaaataaggtagacaaggaaagagaggggacaaggcagaacaggactcaaaggggtgaattctgagccccagcctgaccctcctaactcattggtgcctagactcacgcagacaagctgggcccagaatctgagaacaccccaaaaatattagcgagtctcccccaggacccaaactctctttctcagaaatccttcacagctgccaagatccacccatgactgacaggatccctcgtagtttctggaaaaccctgtcacagtccccaagattccccacctagtctctgacaccacctaatagacctgggaaccatacaatgcttcccaagaccccctaatggccaaagaactaatgtatcccacacacatgaagctcttcctacaaagccagggcccacttggggcactcatgagcctccatggtccaccaagacatcctcatggcccccacgaactcctcgcaatttcacaagatcatctcagaaacccaaaacacatgagacatgaacacagataatttaaacagtaccagggaccttccttagagcccctaagaccttgcccccaaatcaccagtgcatcgaggccatccctagctcctaggatcactcctcagtcaccaggagccccctcccagggcctctggatctcaccttaccttgagcacctccctgggcacctgagcagggggtggacggctcaatgtgtggcccccagcagagacgccaaccacagagatggcaggagaggcaggtgcaggactggggaagggagccgcggcggcctgttcccgacgctcacgcctctcctgctcctgcgcctgggcccgcattagctgctgccgcagcaagaccctcgatgaagaagatgacgacatggcaggggtcctggagccccctgcagaagacgatgcagagagtgtagctggggtggctggtgtggcctgcagtgatattgggaggctgtggaatgggaaatatggggccatattttaggtaagctaaaagtctcatcccaagcctaaagggtcttagcgtgacggagcagacacaggaaccaggcctgttctctgccttccgaggccacaatgtagaagcagagacacaggaaccaggcttggtgatggctctcaggggtcacagtctgatgggggacacactggaggtcagtctggtgggggagttttagcctttggtccttatggtgaagcctagatttgagcctgttcacatattaagtggagatgctattgttcagctctgcaagggggggtttgtcctatttacaggagagcagaagaagcagaattgaggctttggcagcagaatgtggatacagagggctcctaagcccaatgtgaggctagagaagctctctgagctcctgggggtgggcgtcaggtgataggagaagccccaggttcctcttcttcccctgcctgggcctctggtcccaggagctagtcagtcttgaaaacctcggagatttcacaatactctcttcctgcccctcttccccctcccctcccctctctcagagcccgggccgatgactcagcacatttagacttccaagcttggggaaagaagagaccagcaggggctcctcaagggctgagggtgggtgagttggtagtgtgggaagggactgagttggggctagaggcatgtccccgcccacccggggacatgagtttaagcaggccacgccctatctctgagcactccaggccggctggaacacctgaggctgaaacacttgcatatgaatgggtgtgcaggtgggctgggggcaggcaggggaggtcttgacagagatactggaatcctagcttggccacctactttcctgtgtgacatgctctttctggtccctaattttaccaccactagaaaacgcaggctggtgaaagaatgggttgggctggtactgagggcctctgcccatcaagaggggagaggagggctgaggaattgggaggggaatcagatagacaagtcatacataccttgagcgaaggggtaagggttggcttttgagctcgtagaagctgtcaggatcaaggacgttttctaattctatgtcagcaacaatcccggattccggaagcaaagagttcaggctgagggggaggtggagtggtggtcagtgattgaatgaaggaccttattccccagccctcccctgagacagagaaagagacagagagcgggggagaacgaagaggagggtacaagcccctcatatttggccaccttgctgggtaccacaccaccatgaattcccacctccttcccccatccccctttcccttccccactgtgttactcatagtcccttaggagtcagaataataagaacgcctgcatcccaacccccacactgtaacaacctgggtttgaggaaaacagaatttaggaataacaattcactttatagaaggattcctgacttcctattcagagttctcccagcccccataccccctactttttttttttttttgagacagagtatcgctctgtcaccaggctggagtacagtggtgcgatctcagctcactgcaagctctgcctcctgggttcaagtgattctcacgcctcagcctcccgagtagctgggattacaggcacacgccaccacgtccggctaatttttgtatttttagtagagacggggtttcaccatattagccaggatggtctcgatctcctgacctcaagatccgcttgcctcggcctcccaaagtgctgggattacaggtgtgagccactgcgcccggccaaccccctgctattttctttacagctgaatgtgagcccaggtatatgtgtgtacacacacacacacacagagcaagtaggggcatccctcagcataacagtcccttgtaacacaaactgaatgcatcacaaagagaactggaaataattcacttgacgtaaagatctaccatttcacaaatgagtttctcccagccccagccagagttcatgggatgccaacacatgcctaaatataaaatagaaatatcaaaggctcccctcgctccaacagactggatttacaagagggagaatttgggtggttgatccactttatacaagcattcttttcttaccggaggagcctgcccagccttctcctgtttttttggatagatcaaaacacacacacacccccaacactaacacccactggcgcacaaaataagaagccatatacacccatccctttaactatgtccactactgcgatgatctaggttgttacagaggaattagaagatggtgaatcgatatacagaaaggctctgctcagccccagagagcaagggacagttaacacacacgtggatgaatatgcatccttcaatttagctaaacatttagaatgctgagagattgctggtgacttcacttgacaagaatcctctcccctccccaaggatctgtcttccttcctctcctcaccctcagatggagccctaaaaccacccaggaagttgggaagaggaagctcgggcaagccactgagctcagcacaatcccaggcacaaaggaggcaaagaccccccccacccagggctcacacacccattgcacagaagttggaagagatgggcactggggtgagcagggagggctggggctccaaagcccattgatgaaagtaaggatgagaagaggccagaggggatccacccaggcagggatggtgcaatctgtactcgttccagctctatggacagattcaagattacccccaggagctcggagatcgaaaagaagataaaaagaaaaggggtgtggggctagggagtgggaagggctgagaggctagagcgagtagcagcatgaacaagagcctcctctgggttcccaaacaaggtctgaggcctctgagctaagaggtaacatcatcgccctctgcctggctgtctatcttccattcaggcccttaacaggtgtgggaagagggcttttccactatccttgggatctgccccagctgggtaggcgggcagaggggaaaggattattctggtcaagtcttgctgaatgttgcttctcttgttcattcacacgcactcacaaggctggtcccaggcagcatatctgagatacctccaaatccctccagattcatgttatccccaaacacagcaaccagtcactgagaggcaccaagctcccaagacagcacttctgtccctcaggaccccttctcccacactgagggaaaaaagattctaggattcccttaaaaccagtgcctcacctgacagtgtcccctcaaattcattcccctcatgtccgactgaaaatccccgaattcagcctctaatcagagaccctgtctaccaagttcagctatctcagaccagtttctggatactccagaataggccccgctagacgcagtcaagggctccccaaacctgacccagaccccgcttaatgcactcccacgactcctttaataaagccacaatccaagcaggccactgccggattccttaggtgcccccccaagacgggcgccccgacgtcctccaaggctaggccgagggcctccaatcccagtccggggcccccgctgcccccgagatcaggcccctgggagccccagtcggcactcccagccccaggcggccccgcacctgagcagctgagccgagtcggccggcctgcgctcctccaacagcacgaacacggctcgagggccctccgcgctggcctctacgccatcccgagctggttcggccgcatgagacatgacgcccggccccgggcgagccctgccaggccggtcgggcctcggcccggtccccctaacaaaataagagtcccccctccccccagctcgccactgccgcctcctccgctaagccatggagctagcactgcgcgggcgggcggcgtctgggagatgggatgggctgtgagtcatcccccgcccagaacggaccgacgccccccctcaacctaaccccggacgaccgccctcctccccctcgtcttcttccccctcctccctcctcccagggatggggaaactccacaggaagtgaccgcactggggatggatggcccgtctggccacgacccattagcgaggcggccaatcgctgaacggcgattcgagggcccaccctaagcgacgcctccgacgcggaggaaaaacgcgattcggcccgccctcattccgagaagcagcacccagaccacgccctcaggggcagcgacaaataggcgagggttgatttggttgaaccacgcctctatgtttgcgtcgctttcggagccacgccctctcttctcaaattatccctctgcaaggtaatattaagccgctccttgggtcctctgcgcctgcgcatcgatggccagtcggcgcacggagggtctcctggccaagcttttagctgcggaaccgcgccctctttcggccaatatttgtaatatctgagccctagaccgcgctccaacctcgatctggctgtgctctctcagccaaagccataactatgaggcacaggcagctacattccctgaaggtgcgggccagaaacccccccctttcgctgtccgcagtccagccgcccagctggtcttccgggagtattccgcctgttccatgccatcgagagcggttgtactatgttcattgcgctgcgcaatatgtgcttaataaattcttgacgggtgaatgaatctggtcccttcggtgaatgacgacttctggaatcacaaagatccaggtttgaatagggaaggggacctcccctctcccagcctcagctttcctggcctgttaaatgggggtcaaaatacctgtctggcagggttgttctgaggattaaagataatgtatgaaaagtgctagcaggttgtttggcatacaagaagcttcccaaaattagttgattcactcatttgttcacttattcaacattcactgagcgcttctgtatgccagacgcatgcaagccggctcgcacaaggcggagggtctcactcatatatcctcaggtgcaaatagctcacaaaacacccagacctacagccttcccttcctctttcctgacatcccaagaccccaccctgagttgcgcctccaggaatttcaccgggctttcatttaccttggaccttcctgtattggcatcattatttcacaggtctgtcagttgctttcgtaaactcatccatactcacacacaaccatctcgtacaagggggaaacctctacataataaagatgacttctggccgggcgcggtggctcatgcctgtaatcccagcactttgggaggccgaggcgggtggatcacctgaggtcaggagtttgagaccagcctggccaacacggtgaaaccccgtctctactaaaaatacaaaaaattagccgggcgtggtggcgggcgcctgtaatcccaactactcgggaggctgaggcaggagaatcccttgaaccaggaagcagaggttgcagtgaaccaagatagtgtcactgcactgcagcctgggtgacagagtgagactcagtctcaaaaaaaaaaaaaaaagaaaaaagaatacattaccaattgtaccaatcaaaactctaaaacggaacttgtagatccaatgttaaaattcctatgatgccttaaacatgtaagaatgggccgggcacggtggctcacacctgtaatccagcagtttgggaggccaaggttggtgggtcgcttgaggccagaagttcgataccagcctggccaacatggcaaaacctcgtctctacaaaaatacaaaaattagccgggcgtggtggtctgcgcctggcctgtagtcccagctactcgggaggctgaggcaggagaatagcttgaacccgacaggcggaggttgcagtgagccgagatcacgccactgcactccagcctggggcgacagagtgagactctgtctcaaaaacaaaaacaatggcccagtgcggtggctcacgcctgtaatcccagcactttgagaggccgaggcaggtggatcacttgaggtcagaagttcaagaccagcctggccaacgtggcaaaaccctgtctctactaaaaatacaaaaaaattagccaggcatggtggcgtgcgcctgtaatcccagctactagggaggctgaggcacaagaatcgcttgaacccgggaggtggaggttgcagtgagccaagatcgtgccactgcactccagcttgggagacagagctagactccgtctcaaaaaaaacaaaaacaaacatgtaagaatggctaattttacaaaagaagaaagaggagggtctggcggggtggttcccacctgtaatcccaacactttgggaggccaaggtgggagaattgcttgagcccgggagtttgagactagtctgggaaacatagggagaccccgtctgtacaaaaaaacttttaaaaaattaggccgggcatggtggctcacgcctgtaatcccagcactttgggaggctgaggcgggaggatcacaaggtcaagggattgaggccatcctggccaacatggtgaaaccccgtctctactaaaaatacaaaaattagctgggcatggtggcacgcgcctggcctgtagtcccagctacttgggaggctgaggcaggagaatctcttgaacccaggaggcggaggttgcagtgagccgagattgcaccactgcactccagcctggggacaaagtgagactctgtctcagaaaaaaagaaaaaaaaagaaaagaaaagaaaagaaaaattagccaggtatggtggtgcacacctgtggtcccaactacttgggaggctgaggcaggaggatcgcttgagcctggaaagtttgaagttgcagtgagccgtgtttgtaccactaccctccagcctggacgacagaatgagactctgtatcaattaatcaataaataaaactacatactgtctgatgaaagatgctacaaagttaaaagacttacaacagactggcaacaaatatttatagcagtagagccacagagtaattatcttgtcacacatcccaatcctacaaacaccagcttcacacacgcatctcaaatgtctccatgacaagtgatatcccatgacaccctgcatgatatgcctaccctgcatctttctgggtttctctctctcttttctttttcttttttttttgagacagagtctcgctcttgcccaggctggagtgcagtggcacgatctcggctcactgcaagctccgcctcccgggttcacgccattctcctgcctcagcctccccagtagctgggactacaggcacccgctactatgcccggctaatttttttgtatgtttagtagagacggggtttcaccatgttagccaggatggtcttgatctcctgacctcgtgatccgcctgcctcggcctcccaaagtgctgggattacaggcgtgagccactgcacccggacttcttttttctttttctctctctcttttttttttttttttttgagatggaatctcgctctgtcacccaggctgaggtgcagtggcactatctcggctcactgcagcctctgcctcctgggttcaggcgattctcctgcctcagcctcccaagtaactgggattacaggtgcccgccaccgcggccagctaattttttttgtatttttagtagagacagggtttccccatgttggccaggctggtttcaaactcctgacctcaagtgatccgcccgcctcagcctcccatagcgctgggattaaaggcatgagccacatgcccggccctagtttctatcaatatctcattctcaactttctcaatacttgcacccctgccatatagttggagttcctttctttctttctttcttttttttttggagacagggtttcgctctgtcatccaggctggagtgcagtggtgcgatctcggctcactgcaaccttatctggggtttcactgcaagacaacttcaaggtgctgtgaaggggacatgtggagcgaagtgggagggcagctggatggtgaagttgggggtatttagggatagatatgagtggtgattgaaggtggcttgggggtgagtttgggttctacaacaggacagtttgcaggcaattgaaggatcatttgaaggtctttgggaggaatggggcttcaataagacagtttaagaatgcaggtgggagctattgggagggtggattgggaatacggttaatgggtggaggatggtttggggtacagttggagggaatataggaagatgggtttttagagatagagttcggccttctgtaaggtggtttaaggaacagatgttaactgtcataagatgttgtggtaggctgaataatcccctccacccctgccaatatatttatgtcctatgtcctaatccctggaatttttttttaattaattaattttttttagacaaagtctcactctgtcacccaggctggagtgcagtggtgtgatcttggctcactgcaacctccggctcctgggttcaagccattctcctccctcagactctcgagtagctgggactacaggcaggcacccgccaccacgcccggctaattttttgtatttttaggagagacggggtttcaccgtgttagccaggatggtcttgatctcctgacctcgtgatctgcccgcctcggcctcccaaagtgctggtattacaggtgtgagccaccgcatccggccaaggaactctttttttttaaagagtcttgctctgtcacccaggctggagtgcagtggtgtgatctcagctcactgcaacttcgtcttcctggttcaagcgaatctcttgcctcagcctcccaagtagctgggattacaggcatgctgcaccatgccccattaatttttgtatttttagtagtgacagagtttcaccatgttggccaggctagccttgaactcctgacctcaagcaatctgcctgcctccgcctcccaaagtgctgggattacaggcatgaggcatggcgcctgccccctcacccattttttttgtttgttttttgagtcaaggtctcactctgtcacccaggctggagtgcagtggcatgatcacggctcactgcagcctccatctcctggactcaagcagccctcccgcctcagcctcccgagtagctgggactacagatgtgtgacagcatgcctggttaattccctggaacctttgaatgctactttatgtgacaaaaggactttgcaggtgtgattaagttaaggattttgggatgaggagattgttctggattagctggtagaccctaactgtaatcctaaatgttcttataagaggtaggcagaagcaaattcgactgacagaaaaggaggaggcaatttgaccacggaggcagactgtagtgatatgactgccaaaagccaaagaatgcctgaagaggcaacagatagtcctttttgtttgtttgtttgtttgtttgtttcagatggaatctcgctctgtcacccaggctggagtgcaatggtgcagtcttggctcactgcaacctctgcctcctgggttcaagcggttctcctgcctcagcctcccaagtagctgggactacaggcgcccgccaccatgcctgattaatttttgtatttttagtagagacggggtttcgccatgttggccaggctggtctggaattcctgacttcaggtgatccacctgcctcggccttccaaattgctggcattacatgtgtgagccacctcacctggcctaaagacaatttttccatggagtgtggtgggggatggtttcggaatgaaactgttccacctcagatgatcaggcattagttagattttcataaggagaatcttgtaagcatgtaacctggatcccttgcatgcacagttcacaatagggtttgctctcctatgagaatctaatgccgctgctgctgtgacagaagctggagttcaggtgttaatgcttgcttgcctgccactcaggctcctaacaggccactgactggtacttgtccttggcccaggggttggagatccctgccttatagcctccagagggagtgcagctctggtgacaccttaattttggcccagtgcaactgattttagacttctggcccttaaaactgtgaaagaatacatttctgttttttgtttgtttttaagagaggtagctatttatttatttatttatttagagatggagtctcgctctattgccctggctggagtgcagtggcatgatcttggctcactgcaacctccacctcccaggttcaagcgatgctcccacctcggcctccctagtagctgggactacaccatgcctggctaatttttgttaaatttttttagtagagacgggatctggccatgttgtccaggctggtctcaaactcctggcctcaagtgatctgccagcctgggcctcccaaagtggtggtattacaagggtgagccacgcaaatttctgtttttgtttcttcttcttttcttttctttttttctttttttgttttttttgagacggagtcttgctctgtcgccaggctggagtgcagtggcgagatctcggctcactgcaacctccgcctcccaggttcaagcgattctcctgcctcagccccacgaatagctgggattacaggcatgtgccaccatgcccggctaattttgtatttttagtaaagacggggtttcaccatgttggccaggatggtctccatctcttgatctcttaatctgcccaccttggcctcccaaagtgttgggattacaggtgtgggccatcctgcccggccctctttgtttttttaagccaccaagtttgcagtaattggttacaacagccacagggaagaactacagatggctttggggaagagttgggggtcactggaaggacttagggctacgttgggggttaccaagggcagtttgagagtataattagaggctgtgggaaagcatttgggtgcagttggagccatcaaagggaaaattgaggtgggatttggggggtcattggagggtggatgggaggtatagttgggagactgtggggaggtaaaggggaaatgtttacaggtagcattgggtgctattagagggcagtttagggtgtagttgggagttcttggagggtggtttgggtggtattgttgggaaaaattgaaagatgttttgtgggtgtagttgctcataatttaagacaaggttggggctgggcgcagtggctcacacctgtaatcctagcacttggggaggctgaggcgggcagatcacctgaggtcgggagttcgagaccagcctgaccaacatggagaaaccccgtctttactaaaaatacaaaattagccgggcgtggtgacacatgcctgtaatcccagctactcgtggggctgaggcaggagaatcgcttgaacccaggaggcgaaggttgcagtgagcagagatctcaccattgcactccagcctgggcaacaacagccaaactgcatctccaaaaaaaaaaaaaaaaaaaaaaaaaagacaaggttgggcatggcggtcagtgaagagtggtttgaggttacagtctgggtctgcagttctgggaccaaaggaaggtagttagtgggtagagtcatggctggggctgttggaaggggaattttaggggtggggtttggaattgttggagagtagtttagttaggtttgggtattactgaaaaggcattttggggatattcttgggagttgataaagggcagtttgaggatgtagagcagactgctggaaggtggtttaggggtgaagatgaggctcgggagggaagtttagtgatgatatttggggattatagagtggtctggggtacagttgagggctggtaggtatggtccagtgtgcagtttgggggtctgttttgaagtctggatgtcagaggggtgttttgagttgtggttgaggagctattggtgggtaatttggagagaagttaaagatcattggatagactactgttcagcaataaaaggaacaaaccactgttacatgctaccacacggatgaacctcaaaaacatcaagctaaatgaaagatgtgagacacaaaaaatccacatattgcatttttatgaaatgtccaagaaaggcaaatttatagagacagaaagtagatttgtggttgcctatggttgggaatgggaatggcattcagtcatgagggatttttttggggtaatggaaatgctctaaaactgggctatagcgattgttgcacactttggtaaatatttttttcttttttttttcttttctttttttttttttttgagacagagtcttgctctgtcgcccaggctggagtgcagtggcatgatctcagctcactgcaacctccgccttccaggttcaagctattctcctgcctcagccccctgagtagctgggattacaggtgcctgccaccacgcctggctaatttttgtatttttagtagagatggggtttcaccatgttggccaggctggtcctgaactcctgacctcaggtgatctgcccaccttggcctctcaaagtgctaggattacaagtgtgagccactgtgcctcacttaggtaaatttactaaagttgttgcattgcacacttaatcgtggatgacttttatggtacataattatcattattattttttgagatggagtctcactctgttgcccaggttagagtgcagtggcactatcttggctcactgcaacctccacctcctgggtttaagcgattctcctgcctcagcctcctgagtagctgggattacaggtgtgagccatcatgcccagctacttttttgtatttttagtagagacggggtttcaccatgttggccaggctggtcttgaactcttggcctcaagtgatccactcgccttggcctcccaaagtgccgggattacaagtgtgagccactgttcccggcctggtacgtaaattatatcccggttaagttgttttaagaaaaaaatcactgagagtgctttgtaatttaggtcacttaagtatgatccagggtgcaagtaagtctttggagggcttaggggacacatttggggccactggagtatgatttgggagcccaattgggtaactacagcaggatggttggtggctattcggaggtacagttgaggactgttggagagtgtttgaggtgcagtttgggtcagtggagtgtgggttagaggtgtagatggtgctggagggtggcttgaaatgcagttgaaagaccacagaaagtatagttgggttatatggcacagtgataggggctgttggaaggtaattttgtggggatacgaggggaggtcaatgaaaggtggctgggtaagaggggtccatggaacatggtttggaggtagtgtgggtgactgttggaattattttgtggtgcaggtgaggcccacgttgagggtaattaggaatgtttgggctggtgttgggggctcctggagagccattttgggtcaatggagtatggtttggagggtacatggagaggagtttggggtcaatggagggtgttacgggtgcacattggaagtagatagcaggtgatttggacatgctgtttggagggtaatggtttcagggctgattgcagatggtttgatggagcaaactgggggtagtgtaaggtagtttactgccacagcttgggtgtccatagagggtggactggaggtaccgcttggaatcaacagacagtagtttggggatataatttggaggataatggaggttggtttggagtgcatttgaggaacaacagggagggtagctggggtttacaggtgtggggatagcttacagagagcagcttggggtactgcttgagggtccctgggggacgacttggggtgaggggcgccagtaggctccctgaggggcgtggcctcggcgagggagggctccgccgccctcgagaaagcgtgtgcgcacgcgctcccagcttgttcgctcctggcgctcccagggcaagaaaaatcgaagacccgagccggcgcttgcgcacttagtctccgccactgctgtggtctcgtgccccgccccccggtccccccaccctctaggctaggctgagcggcggaggtggccgtgccgctggaagcggacagacccgagttagaggtgggggcgggggtccatcgcccgcggccgggccggcgctcccctcctaccctccccgcgacccccgtctggcccccacggctaacggtagcgcagccgaacacggcccacgggcagggcgccgaagaggagcaggcgcgcgcccggggacgagcagggcgcagtgagggaggggcgcgtccactgccccggccggccgaccgacaccgaccccgcctactgcggcgcggggacccttggtgagtaaccagccccgcctgcggaggaagggaggggacagggtggggtgaaggcccggaaacgccgacggggcgtacctgcgcgcgcacccgcgacctctgaccccgtggcctcagccctgaccccttacgacctgactacatcttttttaaacctcaacccctgctggccttggcctcaggaccttccatccgagccctgacctaaccatattctggcctggtatggtcctcaacccctgttttgtccccctaaatccagtcctgaccccaaaccccatccagttatgtcctggggatctttgacctgaccctgatccttgcctgaccccgtctcatctctgaaacatcttgccctatcctaatgcccaacactgaccccagtttctgtcctgacgcttgacctgtctgttccctaaactcttatccagtctccaaacctcttccagtcatgtcctgtccccctaaccacaatctggtgtagttctgtcctgattcctgccctctaacttctgtcctttctctgcaccctatgtgatatcctctcctatatactcgtgatctgcatcctggctcaccaccttcgtctcctgccttgtccctgcccctgactctgccccgtttttccctcttttcttgtcccatcaccatactcattcctatcctcattgtgtcctggtcttttcctgttcctgacctccatcctgaacctgcccttttccctgtcccctcctttgaccactggcttagcctttcctagtcatgtcttctgactgctgttctatgttaatcctgacccctgccctgctgttttgtctctttcttgtactttttctctgacccttgtcctgaaccccaccttatcccatcccctggccagtgttctggctcattccccatcctgcctcttgacctccatcctgtgataactctggctctatcttgtcccctacactccttcctgttctgtcccttcccatcccagccccagggtgttcttccccttaccatgcccctccaccctgttcagatcttcttccttcctaatatccacttgccatcccttctgagccgaggacaggggtcccattatactgtgcccggaacttgaagattctgctgttcccaggacctccgaagtacatcccaaatgcttctcttagcaagagcaagcagccctatgtgccctgcgtggctgatgggggtttttgtgtgtgatctcccctatccccaccctagtgatcttacatagagcttacatttctcttcctgccccaggagggcatgcaactgttcctacgcccctgccctctgcaagtgtgaaagaataccctaaattattcagtgactctctgggagtctgagaggtctgggtcatgtttccagtcttgctgtgttggggactgcctcatgttggggggaagagttaagaaaatatgaagagatgggggacccaggggtatgtatgaatcttctaggccatgtttgattctgggtgcatgatccctgctttcctggactgaaaaagaagaagtctattctaggccaaggctttgggacttggtatagaggagggatggggtcaaggattcattctccttctctcagcagtaagcaataaaaatcttggtgctaagtccactccacctctgtggggcttgtcttgggggagaaggccaggcagtcactggatttaagaatcaggcctatccagtggtaacagtaacaacaataatgcagtgttcccctcattgtccgaatctccttgattctgaggatgatggggagaacttggatagctagagggtaatgtgttactcaattgggttttgttcctgcatttctcatagagactagtgagtttgaataacaagatgccagacctatcttatcctgaaaatctatccaaacctattgataacaaaacaagcattcctcactttcccaatctatttggtacctgaattctgagagggagagtgcccgaagttcagacagtgaaacctaccaagttatttgaaggtattttgttttcacatcttacatagtgagtagggaaaattgagataatgaagaataatgactaactaaaaaatgtatccaaatctatgaactttcctgagctccagggacaagagttgggatagtgagggtaccctgttatgtaaatggttcctgcattttgtttggagggtaaggaaagttcaagaatgagggataccagtcgtatctcaaaaatgtttctgaatccattcagttcttgcatttggatggtgagagttcagacaatttctctgaatgtatttggttcctgcatttttgatgttgagaaaggagaggttggatcatgagggaaacagctctgtttcaaatatgtctcatttggtgagcagggagggtaccgtgtctagatagcaagtgggatttggaagctgagggataccagttctgtctcaaaaatgcatctgaggccggtcgcggtggctcacgcctgtaatcccagcactttgggaggctgaggcgggtggatcacgaggtcaggagttcgagcccaccctggccaagatggtgaaaccccgtctctactaaaaatacaaaaattagctgggtgtggtggcacgcacctgtaatcccagctactcgggaggctgaagcagggaactgcttgaacccgggtggtggaggttgcagtgagccgagatcatgccactgcactccagcctgggtgacagggtgagactccgtctcaaaaaaaaaaaaaaaaaaaaaaaaaattgcgtctgaatacatttagtctctgattttggatagcaagagttcagacaagttatctgaggaaaaacaactgtttcaaatgtatcaagtgagactgaaggacaccagctctgtctggaaaaaatgtgtctgaatgtatctacttgattcctgacttcctgtggggaagaatacttgtaactgtgacagccaacatacactgagctcttaccaggcactgttctgcacaagctttaaatgtattaactgatttaatgctcacaatagccccgtgaggtacatactgttatcatcgtccccaattgacagagaggcacagagaggttaagtgacttgttcaagcagtcacacagctagtaagtggcagagctgggttgaatcccagactcaccatttactagtgacagcagggtcacgtgaggcccagggcccagctggggtagggcttagaggttgggtcctcttcgaggctattaaaagtcatggaccagggcaatgatgtgtgttagtgactgccccatttgtctgcctggcccaggaggtccagttacctgctctcccccagttacccccacaacagcccacctctgtgtgagtgtattaattgttgttagtaagagtcattaatgacatggtgtgtttccttgcactttgaaatgcctttcaaagttatttggggcctccattgtctctgtaaccaccttttacccattttacagatgaggagacctaagctttgagactcaatctacattgccagccagattctcatccctcttggctctgattttattactgtctcacttcccaacatctttggtggcccataagaggtgggagaggctgtggccgagaggacactccccaatgcccaccttaccactgcccgccccaggcagtgaagtggggagggcgatgaaaggggcctttgtgttccatgctggaaatctcacacccaggaagaaaggtgggcagggatggcgggaggccttaatagtatgagtctggggcattgctgattcagagtgagctcctctctaggctcagcccatctgcagcttttctcacttcaggtcatggtgtgggctgctgcaggggtctgggtagggcttgggccctgggtcacagagcagatggtcctgaatggagcacaggatgtgtgctgtgtgccgggactggcccagagctcaggtggtagtggtgatggtggtggtggtgatggtggtggtggtgggcggggtgaggggaggcagggacagtacgtcgtaaggactcaaagctctcatttccttctctggcatgaagcctgactctctgaagaagagagacccagcatggatgtgaagaagcatgagcccccttccctacttctccttcccacttgcaggagtagcctctgtctgcctcccagccaggacccagcccccggaaattctgatttcacctgctcttctgccactgtgatctgaatcaggcctcttcacctttccaggcctcagcttctgcatctataaaatggctgtgaggaggctgggtctgtgccatcctgctacatttgtaggaaccaagagggatcaaaacccataagtgttttgtagggtgtaagttgtgcttgatttattgagattatttcttctggagccacagaaggatcttgagacctgacctctccttagaaaggttgacttcctctgtccccaacttgggaaactattattccccagtgagggtgggaattgccccaaggccttctaccactgccttgccctgggaggaaagggtaggggcctcagaatgtgatgcttagtgccaagacacaaaaactcagtttacacccgaagcctcccatgtactttacagctccccacacctctatggcccagatccaagttgccccttgggtgggcagcgtctaatcctctgggaatttgggcagtaggagaggcagctgctactcccaccactctcagcccttcttcccagttttctgctaagtgtacggggtgaggaggcacaggcctccatgcctggccagttttaaaaaaaatttttgtagagatgggggtctcattatgttgcacagtctggccttgaactcttggcttcaagcaatcctcccacctcagcctcccaaagtgctgagattacaggcaccagctaccctgcctggcccaggctgtcttcttagacatgctgagcaccctgagtggacctggccctgaaactgcccccaggggtgaccctagtcctggtggcagacaggcaagggttaaaaggtgtgggccggcccagttcctggccaggtaggctgggccattacctagtgggaggtggccaaggcatctgccactgctgctgactgccactaccagccggagccagggcctggtcgagacaactatttttgaggtatctgaggctaccccacagcactctctggcattggtgagcacctgggagcagtgggcccagggtgcgagggggataagggcattggggagctggggcagggtgtactgaagttcccttcggtagagagctaggtctgtgggagaggcacaccaacaatgcagggcagggtggtggtgggggggtaggggggcagtgagaatggagggcctgaggacaggggcaaagcccaaaacaccaatttcctttcctggcaccaagccgattcccggccggaaatggacgaggagggatcggggaaaagagaagtatgagtccccccttctccaccctatccctgcttcctttcctccccgccaggagtagcctctgtcctcccccaacccagggcccagctctccaagaaagaccagactgggctactaagaaaccattactcaggcacctgcctgcctatgcctgatttgttcactgcagtggaggaagcaggggctctggggagggtaatggcccagacattgagattttgtatttgctctaatagtggcaggatgtggaaatgaccccccaagtgttggggtgccacccaggtgaggtatcttggttgtaaacagttattacagccaggaatttctttctcggctgtggtgtcagaatggcagacctgaaaaacctgccgggcccgcctctgggtgtggggggtgccctctactgctctcccgctgcagctggtccctgggacaggatgggggccatggggtcactggtagggggagacctggggttggtgtgggggtgtgctggggaggggtttgctgggatccctttctcgccatctgggcggggatgaggcagctccaggccccaaggcaagtatgcagagggcaggtgagcggaggcagaagcttaggaactgggtgtgggggtgtggggcgttgactgtgtctagcctgcccagtgaccccatgactcatactctaactatgtccccccgaggtcgggctgatagggaggagttggggttcctgtgtggaccctgtctggacttccaggacgctctgagaaattagagaagaaaggattggctgggtgcagtgcctcacgcatgtaatcccagcactttgggaggccgaggcgggtggatcacctgaggtcaggagttcgagaccagcctggccaacatggtgaaacccaatttctactaaaaatacaaaagtagccaggcatggtggcgtgcacctgtaatcccagctactttggaggctgaagtgggagaattgcttgaacctgggaagtggaggctgcagtgagccaagatcgtgccaccactgcattccagcctaagtgacagagccaggccctatctccaaaaaaaaaaaaaaaaaaaaaaaaaaaagaatcgaagcagcccagcatggaattgggattggattgggaccaatgctggcaagggggaccgtggatggagttgggttcctgtgggggtaaaggaaggttccagggaaccctgtgagagttccttgggcctaaatgggggctgggaaagttggagccccagtgatctgggatgtggaggaacccctgccatgctgggaagtgtcagaccttagatgagtggggatgtggggcctgggtttgtcaaaaggctttagggactgatccccacccctgctgttgaaggcagggcaccactgcttcaagagaggggtacaggccctatggggcaggcaggaggactgcagagaaacatgacaccttacaagcagcttggcctcaccccacaatacacagatggggaaggggcttgaacccatgcctccttggttggctgggtcttcctcacaccaggctaacatgtcatgacaagctgccgacttcaaggtaggtgataatggagctctgtggccccataaagccctcccagtcacctgccacctaggttaggccaggtggtgggaggtgatgtcactcagctgcccagctggggactgagcatgatgtggaaggaagggagcaaactccagaggaggggtggccagccaaggcaggttccatggtcagctgagccatcgggggcagagaaggaggcaggaggcaggtggttcgttatttgcagctgtggactttgcttctcacaaatcccagcaggaggacttccctacactaggctcaggacaggctgtcatggcaagaggggctggagggaccctgggtcaagtgaacattctccttgctacactagagctacagaatggagttgggacaagcacagacccacagatctgagcttgaaccctggctccaccgcctcctcatttacttactctatcttttattcattcagctggcacccattcattgagcacttgtgtgtacagccatgttcagggtgctggtgatgctgctgaaaatgggacagataatgtttcctgtcctcgtcgatgttccaggaggcacaatctcttgttggacaaccgtttgtgagaggatataactgtggaagtgataattaagttctagaatgataagtgtgatgcaggggctggggtggtgagaggttgaagaaagcacttcaggcagcatccacagcctgggcaaaggccctgaggcctgagggaccagggagcttatgaggaagttggtggagttagagcggttctcatgagcgagagtgtaggaccagaggggtgggcctggtttatgtctgtggctatgggccagttatttcacctctgtgccttcctttcctcatctctaaaatggggatacgaatctttccgggtggctctgaagattgagtgtggcatcataggtaactgttgcaggcacccaggtgttgactgcgtgtccattgttgttatagttggttgaatctgtcccattaattctccttccccaggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcaggcacgtggggcccaggttaccccttattccccgctgtggcatgggaagctgggaagggctgggggttggggtatcatgggatgtgcttccttaacggttcctttgtgtcactgccagactttgtccagccatcagccacggcctctcgacagcaccaagatggaagtcaaaggtcagctgatcagctctcctaccttcaatgccccaggtcggtggctgcttcccctcctgctgcctcctcccctgctctgaatcaccacctgcttgctcgggaagagttggtcccttgccccacagctgctccagaatgccctggctgtcccactgatctttgctccctctgtgtccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggtgagggcctggccctaggggtatcaggcggggaggttgggaggaggtgaggagctggggcccctaggtagacagacttgggtggcaattcctcaaccacttgtcttggctgtagattccctgtcacctactttctcctcaaagctcagcttagatgtgttagaatgaatgaaataggctgggcgctatggctcacgcctgtaatcccagcactttgggaggccgaggcaggtggatcacctgaggtcgggagttccagaccagcctgaccaacatggagaaatcccgtctctactaaaaatgcaaaattaggctgggcgcggtggctcacgcctgtaatcccagcactttgggaggccgaggtgggcggaacacgatgtcaggagatcgagaccatcctggctaacacggtgtaaccccgtctctactaaaaatacaaaaaattagtcaggcgtggtggcgggcacctatagttccagctactcgggaggctgaggcaggagaatggcatgaacccgggaggcggagcttgcagtgagccgagattgcgccactgcactccagcctgggtgacagagcaagactctgtctcaaaaaaaaaaaaaaaaagcaaaattagctgggtgtggtgatcctagcaacttgggaggctgaggcaggagaatcgcttaaaccctggaggtggaggttgcggtgagctgagattgcgccattgcactccagcctgggcaacaagagcaaaactccacctcaaaaaaaaaaaatatggtaatagaggcccactgttgacaatttcaaatccaacaaacctcagaaaacaggttctgtccaaaatttggcagcacagtctgacctgaactggcacaggctgatctgtagtttcagtttacccctcttactgtgaatgcccacagtgtgccggaaataatactacagctcagaccacgcagccacagcccctgaagtgagttatataatgcttaggatctcgatggtatcacctttataaaaacaaaacaattctggattccaaagcaggtctccctgcctcccatgcccaccaccccaggggtttgggccactgaggtttgggcacacctgcctagtggagatactggtaggagggaggggagtatcgtgcgtggttgctgagcagggccaggctcctggtaggacttctgtagcttctgggatcattaatgcttcaccccatccttccaactaacccttggtagtctctgacccctgcctcccaccaggagctgactggccagctgccccctgagtgcccactagagcctggtgaacggccccagttggtccgccggcggccccccacagcccgcgcctaccctccaccgcaccccaaccaagcacaccactccttgtgccctgctgaggtgagcagatgggtgtggagagcaagagggtgggaagaggggacaggtacagaggagtagccaggaggaaggtgtggggagggggcttgtggccaggtgagggagaggctaagatgagaaggaaaagggcttctggagttagtttcctgtgatgagggaggatgctggtccctaactgtcaggacaggcctccaaccctaaggaagatgaacagacccagcccttcaccaagagaggccctgacacgccccctccccggggtgaataggtctgaataggctgcaggaagtgcaggccagcctctactgggtttggccccgccaggtccctgttcctggccatttccaacatttgggtgggcccaacaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaaggtgagcatcccctggtgagggtgggagagtggacactggcaaatggacgtggtagggctgggatgggtgactggccggtgaaaaccgggaggtaggcacaactcaagtggcccaacccgtgagaagagttgcgacaaactggcttaccggaaaggacaaactgtgggggactgatgaatatctgccaggacagtcaggaaccaaactggggtggtcttgggctctggtaaaagcagattcttgggacaggaacaggatgaggcggaaactggccagaaggtggcccaagtagaggtgcccacccagtggtgtaagggggcagcacccaggcctgggagtgagaggcccacttctccccctctcacctgtagaggacgtagttctgcactcagagagcagctccctctcagagtctggggccagccatgacaacggtgaggactcctatcccccaaacctgcccccgactcctacgtccctttagcccatcccctttattcatccgaccacatcctgcatgatcagcccatcctttgatgcccagcccctcctgtgctgcttcagcttctccttagccatgctccatcttcctatgggtcccccatcttcttagcctcaccccaccccagccccacagccccagaacctacttgtcagccttagttcctcctcagcctgcttaacctgtcccagcactttgcccctccccatggccttgccccccagcctgtcctgccccctctgggcccccctcattgaattctatcccacttgctctcttccactcagaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccaggtgagaatgagcccctcctcccctccgcaggagctgggaatgggatagcaagcctgggctggcagagggtctgctggtgggtacagtctctaacctaggcctgcctgtctctgtctagccccacacgctcgctgcccaggagtgcctccagttttgaggggcgaagtgtgcctgccacccctgtcctcacccggggcgctggcccccagctctgcaagtaaggggaatctgagggtgggctggaggatcagaggggagggaaccattagttctcactggaagcttgaggacaacattatcaaaaggtgggatggctgggcgcggtggctcacgcttgtaatcccagcactttcggaggccgaggcgggcgggttacttgaggtcaggggttcaagaccagcctgaccaacatggtgaaaccctgtctctactaaaaatacaaaaattagctgggcatggtggggcatgcctgtaatcccagctacttcggaggctgaggcaggagaatcgcttgaacccgggaggcggaggttgcagtgagctgagatcaacatcgtgccattgcactccagcctgggcgacaagagcgaaactccgtctcaaaacaaacaaaaaaacaaaaggtgtgggacatgggaggctgggcattaaaggtgagcaggcatctcggtggataatggggtaggagtcagtctcctcatttgtgaaatggaaataataatatctgcctttgaaagacatggacataataagttctggttagcatatactgagtgcctgccatctgctaggaattagtgttttacgtggcatcaactcatttaatcataatcagatccctgtgaggtgggtgctattgttattcccattttatagatgaggcaagtgaggcacagaaaggttaagtaacttgttagtaaactgaagtcctggagtttgagcccaggcaagttttactctagagtccatgcttttaaccactgtcctcttctgcttcttaaacagagtgcctactttccccaggctctgaacaaaaccaagtccccttccttgtggggcttgcattctgtgaacggtggctgttgggatggtagctttgggtggttcatacgtatggtgggatagagaattcaggcagggttttacatgtgagccctaaggcctaggacttaatcctggaggccgtgcgagccgagccatgagaacggccttagcagggggaggggtcagctggattaggaacagccccctgcccggcatctactctgctagcctttcctctgagtccctacacagatttacacctcccttggagctaacagtgccaggcctcccccacgcatttctacccctgaccgcctagcctaggatagaacctcagctgccctttacatgtcactacctgccacctttatacacacagcttccaaccttgggcccatttggagatgtgaaagtgaaggcttagaaagggctggggtagggagggcactgcacgccttctgcctgatttttctgaccctattcccatgaccctcgcctctcaccccagacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaacccatgtgttgctgctctgtctgcctcaccttgaggacccacacctctagtcaagaccagataatatatttttgcaggaaaaaacataccttgggaatagcctgtgatagtgtcatctgttttgactttacttgctttgtgatgtggggcaacttctttgcctgtctgcactcagatttctagccaacctcaagcaataactcttggtaatataaatggtgataacaaagactctgtccttaacctccctatacattttttaaaaatttttatttttttgagacaatgtctcactctgttgcccaggctgaaatgtagtggcgcgataacggctcactgcagccttgacctcctggactcacaatcttcccacctcagccgcctgaatagctgaaactacagttgtgcaccaccatacccgctaattaaaaaagaaaaaaaaattgtaggccgggtgcgcagtggctcacgcctgtaatcctagcactttgggaggccaaggtgggcagctcacgaggtcaggagatcaagaccatcctggctaacagtaaagccccgtctctactaaaaatacaaaaaaaattagccgggcgtagtggcacgtgcctgtaatcccagctactcgggaggttgaggcaggagaatcgcttgaacccgggaggcagagattgcagtgagccgagatcatgccactgcactccagccagggcgacagagcaagactgtctcaaaaaaaaaaaaaaaaaaaaagtagagatgggggtctcattatgttgcccaggttagtctcggacgcctaggcttgagcagtcctcctgcctcagcctcccaaagtgctgggattgcaggcgtgagctaccatgcccagctttttgagacaggttctcactgttgcccaggttggagtgcagtggcataatcacagctcactgcagcctctacctcttaggctctggccatcctgccacagcctcccaagtagctgggactacagaagcacaccaccatgcccagctaaattttaatttttttgtagcaataagagtcttgctatattgcccaggttggtctcaaactcctagcctcaagtgatcctctagtctcagcctcccaaagtgttggaattacaggcgtgagccactgcacctgtccttccctgtgctttaatgctgatccagaggtcataagttcaaggaagggcctcagagatcacctcttcagcccacatattcaggaagagtctagcagaattgaaaagtaggccacttctgtcctttgaaatgtacaaggactttacccaggaggctcaaattggcatgagagatgcaacaggctttattgttgcagcaacactaacatatacgccccattccctgctgaggcctgtccccacctcaccccttggttgtcgatggtgtggaacattggggtgaggggcaaaatgcctaagcagagctggagggaggcaaatgggactggtgagggtcgggatcacctggaccaggggtccaacagtcaggatacccgactccatccacacaggggcatggaacacttgggttctgagttcaagatttggcaatgtcttgacctgggttggaaggtagggtggggtctggaaaagctttggtccagggttcaagatttgagagtgccttgctccaggccccagtttggggatgagcatggagaagggtggatgggagtgtctctgggttcacaatttgaaattggccatggatgctctggcctgaagccccagttttggggctggatgtaggtggctcttggtcctaggttcaaggctggggaagactcttgtccctaggtaatgggggctgggtgtgagggatatcttagtttggggctggcgtgggggtagggcggtcacagatgtcctgttttgtttgggcagggggctctaggctcctgttttaagtgctgggaaagggctctgggtcccaattatgggctgggggtggggtggtattctccaggtcctgggtacagatcccaggggcctaggatccagcctcctgctcttgtcccagtgcctctagtagcaggcccattggcgtccgcttgagaccaatgctctcgatcttgttctcaatcttgttcttaaggttgcgcaggcgcaacgaggcgtgcaccaggatcactgtgggcggcaccgagaggggtggtcagtggaatagacctcagcctgcagccaaccggggcccaccgaagggaattggcgcgcaggcaggccaatggagtggtgagcagccaggacgcctcagatactgaaagcgtggccgagtaattggcttggcaacgtgggcatggccagggaagacgcccggtaacggggacgtggccagtggaaggcacttaacaccaagagtgagataggaaaggcgataataaaaggggtgttcccagaagggggaacgaagcccgggaaggcgcttttagcgggggcgtggcgaggccctcgggtttcccagccccctctcaacccggggaccggcagggctggcctggtgccttaagcatgctctggctgctttcctggctatctcggggtagtggagactcacgaagcaccggcccggcgatgctgaacaggaaggtgcaagcgccgcccgcgacccagagcaccaggaggccgacggcaagcactgcggccaggcaggctgcagggtggctgcggcggcagcggcgcacagctgcgcgggtctcagctgcccacaccagcacgccgagggccaccgccactaccagcgcgctcaggagcgtatgaagtggccgcacgtacctgcgggtacaagggaaccaagctagccggccgggcggagagacggcctccggaccaccacccaccctgggccccaagagccagggtctcccgtctccggacactccagcctggcacatcctcccaccagccctatctccagcaggcccatctgccagggctcccgactcacccttgtagacccctcctttcctccttgtcaattccactgtcctgtcttcctcaggtccccgcttcaggccctcccatcctgctagacactccccacacccccgggctcccaacacttccctggactttccttccgactctgcccccgtagggcccctcatcagcctgcccgcaagctccccctttaacaccagcccctgcaaatccctctttcaggccttctgtcttcacacgttcccctctccccaggcctagggtccttatagaaccgccctccaggctcccatttccctatagattcctccctccatcattgctaggacctcttccaggtcgtcagccccactctgaactttcagcactgctcaagtccttcctccagattctccatccctctctggtctcaggctttccaaccatggatcctcctcctgggcccaagttccccaacaggtacctgcccctggcgccttccaatcatagccaggctcccctccaagaccggatccccaataaatacatcttccaaaccctccaactttaccgtctatttcccggtctctgccctaagtactccagggtcggcctcaatctggccccatcattcacatcacaccccccctacgcccctcaagtactctcatgtccccctttcgggccctcctttttttccggttcaccttccagcccactttccccttcagtcccacacttgtctccatcctccccatatcttccttgcagacccccatcccccgcaggccctcctcatcagccaggctccatctccctgaggccctccttataactaggctccacctccttcaaggccccccttccaagcccctcaggccgtccatctctactgacttcgcccttcccggccttgcacctccctcaggttccccgtcctggtcctcaaagacctgtgggtctacccccacgctctgcagacgtccctggccaaccggcgcctccctccctcacccggcgagagcgaggccgatgccgaagcagagaaggtagttggtttggtagtagaggaggttgttgatgacgcggtggcaccatcgctgcgggtcgcatggatccggagccgccagacgcgccgaccccagaacaaagtcgtccagggcgcgtagcggtggcagccgcacctccgacatcctgccggttaatgtggctggaccagccaggagggggccggactacaacaaccgttacgcccctcgccaccgcggggcacaccgggaaatggagtctgggctgggcagctttttcctaacctcctaggtggattgcgcaggggcggcgatgcacgtgaccggaaaagcaactaacacgccgctcaggaaagcagcaaaggctgccgggaaatcaagcctttgccacgaagcgagatgctcccaacccttaaaactgccatccacccccgcgcggggcgccgcaggggctgctccgggcggtgccagcggctcaagcacaaagtagccagacagataagaaaggagggactgtcacaaggatccgagttggattccacctccttcctgtcagcgcccaagagggtcacatttctccaggaaactccatgccccgcccctgaggtcaagccgtaaatgccattaagggccttttattcgtattcatcacatcggagatcatctcttcctaggaagcttttaaaaaatccccaggttggattagggcactccctctgggtccctggcaatttcctccaggttagggatcccaaggggtcgctgccttcctgggtctctggcctggcccttggggcacacagtcatcaagaagtgctggggggaagtgagctctttatttagacatagctctgctgagtggaaagtgggcaccagccccattaatgcttgctggctggtggcttccaagcacgccccactgccaaggctcagctctgcagttctgccactgcaggtccctagcacagcccccagggtccttaaaagtcatcatcatcacagatgtcaaggtacacgtcgaaagcctctctgttgcagtttccatcaggagtgaagacatatttgtggaaggtcccatctacgcagatggctgggggagggggggtggtaaaaggtcagaggctgccacagccacaggctccagtcctctcaggcatctcaggacctagggtctgcctccaggcctttgcccagtgctgtcccccttactgatgatgaagctgagcctcacatggccctaaaatcctttcaggtccaacctgcaggcctttgccccatgcagtacccccaaccaaggggctgttcccactcaccaatgacagagttgacgttcttggaagtattgcgaccgaaggcgcagatgcaagctgactcagcaggcacagtgaagctcgccaggctccactgagagtccacgtactgcccaatcataggccccaccttgcccacgcgagccagcctgcaggcagcactggctaagcccaggtatggtaaatgggcagggggacagggacacggtagggtggggagggggtactcacgcggagcggcggttgaggcgggtatccttgagagcaaagatatggacagtacccttatcactggaagcgcagaggaaggaggagtcgtggctgaagttaatgctagaagacagatcagcagtgatgcccacatgtcatgtggtatggggtcaccagcccaccatgcataccctgtgctcaccagtagagggtggcagggtcagtgcctcggcgcagctccaccagtttctccttggattgtgtgtcaaagaggcgaataagggtacccttctgggaggctgaggccactacagtgcctggctggtttagagacacacaggctatgtcactctgatgtgcattgatcgtgaatggagcagacgaggtgccaggctttgtgctcgccaggtcctggggtaggagggaggagtctgaggttggggtggtatggagggaaggggccaagagtccacaaggaagccagtccaccaacctacccacccttgtccactggacggctcaccacaagttgcagactcccacacttgtgtcccgggaacactagcagttgcttctccaggctggggcagaggtcacagagccctagggtgtgaagatggggggtggggtgggcggctgaagaggaggcagcatctcagaatggacagagctggatgaggaccagacttcaaccctccacgataagcttaacccgaagaaccctgagggggctcagctcagctgcacgccccgccagctaggcagattccattccttgctctgcagctgtggaatctagtaagctgctatcacagccccagaagctcagggatccctgacacacccacccatgtcctcacgaggtgtttttgctctgccactggggtacccaggggtggggcaggtccggaggtggggagaactggctgagggctggaaagatggagaggctatgagtgtgagcatctccctgcctctttccccatttctctgtgtgtgagtgccccttcctttctttcctcatctctgcccctctgccccatccactgtttcatgcccttacacctgtgtatctgagccctctcacccttggggttgtcccgggtatcaaactcaaacagctttcggggattgtcggggaaggagtacacatagatgcggttcttcagcacgatcacgatcctgtgggtatcacacaacacaggatggccgtgagggggtggcgggatgcccagggaggactatccctctcacttactgtggggacctcctacctcccaccccggtcctcctcaggctcacttgtcatggcgcatgcgcacagaaagcactggcttggtgaaggtgaactccagcaccagcttctccttggagtccttgccctcccgggcatcgtcccagatcagcactgctgggcaggtgggtgggttgtcggggccaaggtttagggtaaggggcagccctggtgacacaggatccacccctgcttcccagggacctcaacctacttgcttagcctttcaataaacaaccagtgagatcctcgcacagcacgagcacttgtggatatgatccctgagaggagtgttctagactgttacactcatctacagatgaggaaactgaggttcaaagtggttgagtgtctggccaaggacctcaaagctcatcagcaaccaaacagggactcacactcaggcctgtaacttcccctcggtaactatttctgcctccagggtcctagtccatgcaccctggagatttccgtgaggaatcctagggctctgtgactcacctagggcaactcctgccttgtccagatgggatcatcaagaaaaacccttaaagtaagatggcacttgaggctcaagccaagggggtattgggaagacggctccaagattttaaaacctattgcttgtgtgaccttggatgagtcacttaactgcactgggcctcagtttcctcatcggtaaagatggggataatgatccttcctaccccatagagttactgtgaggattaaatgagttaataaacgtaaagtgcttagggcagttccaggctcacagtaagtgctctagggcatggcacacaggaggcactcaatcagaatttttaaaatgaaaacaaagcaccaagcttctcaagctataagatccatgacttccaagctgtaggcctcctctctgtgtgactctgaagtactctgacgtcttcatctgccagtaccttggggtgcctgtgggaggccaggaatccgagaaatctgggccaaagggcaggatgagggcacttacctgagatctctgagaacttgggactactaccaccgcccaccaaggccagaaggttggagcggtgcagcatctccaccaagcccatgctgcccacctgctcgtggtctggacagggaccagggtgtcagtggaggtgggagccaatgcccagcccagctcttctgcccattgcccctcccctgccaacagctcacccagatgccccttctccatcaagggctccacgttgtagatgcgcacacctgtctccatggcgcagcaaaagcagcctgggggatggaaggaatccagactgccttaaagaatgcccaggtaggaagctgggggcccatggcccacttctgacccctcttttcctcgcttcctcccacaagggtacaggcccaatcctctctcactttggtcttggttgaaacgcaggctggtcactcctcgaagtggctgttgagtcatggtgcaggattgttcctctgcatacaaatgggataaagatgagaagagtcctggaatctcccctccaagttctgcctcacctgatttcctcctcctactctgctaactactgactctggagtgactgcaaaaaagataaaaacaggccaggcgtggtggcttatgcctgtaatcccagcactttgggaggccaaggcgggtggatcacctgaggtcaggagtttgagatcagcctggctaacatggtgaaatcccgtctctaataaaaatacaaaagttagccgggtgtggtggggggcacctataatcccagctactcaggaggctgaggcaggagaattgcttgaacccgagaggctgagatggcagtgagccgaaatcgagccattgcattccagcctgggtgacagagcgagactccgtctcggggggaagaaaaagataaaaacagagagtcccagggtctctgctctaagctcccaagatcccaaacaacatggccaggaaccctccttctttcaggtttggcaagctccaggcccacactgacgtggaccccacacctcctctttacatgctggccctcactgacttgtcaggaagtaatgtgatagggggtgcccccgtgatatctcctccccaccgccagccaatcttgatcccaatgccagacatggcctggaaccactcccaacccatttctcatcttcaaacctgacctagcaccggactctctcaataaatagacaaaagtgggctaggagatgcacttcttgtacctccctgacttggccctgggactgctatgcttggtctgccatccccaggaactcctctgctcatacccttctaactgtaccccaacctatttgaccaccccagagtcctctcacacctttccccctcaaccggcttccccaaactccttcaggatgcctaccttgggatgaccccttctcatgccttggtaactacccttcagggccagcctagacattcccttagattggcttatgccctggggactctaccctaggattccccctagcactctaaattttccacccctgggacatctccttccttgtgttctgctgtccttgactacaacataacctggcctggacccaaccccaggaaccccccccatcctcctaagattccccctctagacccctatccaagaccccgccccagggcacccttgccttctaagacccttgcccaaaacaaaccacccaaaactcctacctaggagaacctcaacccctaagatgcctgcgcagtcccctactaagattactgccatagagcccccaacttcccttcaaatcctcaactccccaataactctggccagacatactccctcccccatcctccaagagtccaaatctccttcctttctttcagttacaccctccactggaatgcctcatgctctttctttggacagctctgccttagagttattctctggacagctccaactttcaacaccccttttttgcacctccattccaagactctgtccgggatgcctcgcccctctcccaagaccagccgcatgctccttccaacgccagcacccactcaagacctctgccttagacccctactcgaaagacttccagcctcccccagacccaaccaaccctgggatcgtgctccagcttcctgccgccttcaccggcctgacctccgcgtgtccctgacccgggccccagctgtcggtgccgcccgcggcccggttttctgacctcccgggccttggagcccggctcgggtgtttacatcaggccctacttccgggggagggagcctgtcgcaggaaatgactcaccccagctggaaaaaggcggccaccgccttcctcgcctagttcccgggtcttcggagcatcgcgagtgacagtggggttctccggggagggcgcggggagcggaggaaggttggctgggggaccggaggcgaagggggttcctcaaggccgagactgtctgagggaacccggaagggtggggagagagagcgtgccttgcccccagcaaagcgaaaccggccaagccctcagccccttggtcacccacaatgggggagtaaaccttccctgctaacaagacgcggacctccgcggcggccgagagtagccgcaccggttcgcaacacacagtcctcccaggcttccagaggggcggcgctgggggttacaggcgggggcggacctggagaccttgaaagtggagaaacctccttggctccgagaagccaaggaacagatttcgctttctttctccccaccctgtccccccaaccccgccagctctgagttttgtcttttgtgttttgtttagttttgttttctgagacagagtctcgctctgtctcccaggctggagtgcagtggcgcgatctcggctcactgcaacctccgcctcccgggttcaaacggttatcctgcctcagcctccggagtagctgggactgcaggcgtgcgccaccacgcccatctaatttttgtatttttagtagagacggggtttcaccatgttggtcaggctggtctcgaactcttgacctcaggttatccacccacctcggcctcccaaagtgctgggattacaggcttaagctaccacgcccggcctctgcttttatttttacaaaatacaaaatagctttttgatagtaaaaggtatgaatgctttgggttaaaaaaaaaaaaaaaagaggtcctacctatgataaagcttttaaaaaaaggccccaaattatatgcatactggaaggaattttttttttttttttttttttgattaacagagtttggctctttttgcccaggctggagtgcaattagcgcgatcttggctcaccacaacctccgcctcccgggttcaagggattcttctgcctcagcctccccagcctcccaagtagctgggattacaggcatgtgccaccacgcccagctaattttgtatttttagtagagaccgggtttctccctgttgatcagtctggtcttgaactcctgacctcaggtgatccgcctgcctcggccccccaaagtgttgggattacaggcgtgagccaccgcgcccggctggaaggatttttaattaaactttacattaagaaataataaataggctgggcgcggtggctcacgcctgtaatcccagcactttgggaggccgaagcaggcagatcatgaggtcaggagttcgagatcagcctggccagcatggtgaaaccccctctctactaaaaatacaaaaagttagccaggcatggtggtgcgtgcctgtagtcccagctactcgggaggctgaggcaggagaatcacttgaagccaggaggaggaggttgcagtgagcagagatcgcaccactgcactccagcctgggtaatagagtgagactctgtctcgaaaaaaaaaaaaaaagccgggcgtggtgacacgcgcctgtaatcctagctactggggaggctgaggcaggagaaccacttaaacctaggaggcggaggttgcagcaagcccagatcctgccattgcactccagcctgggagacgagcgaaattcccgtctcaaaaaaaaagggctgggcatggtggtgcatgcctgtaatcccagcaatttgggaggccgaggcaggtggattgcctgagctcaggggtttgagaccaccctgggtaacacggtgaaacctcctctctactaaaatacaaaaaattagccgggcgtggtggcgggcacctgtaagtcccctacttgggaggctgaggcaggagaatcattggaacccagaaggcagaggttgcagtgagccaagatcgcgccactgcactccagcctgggcaacagagggaaaccctgtctccaaaaaaaaaaaaaaaaaaaagaatattcttgaaaaaaaagaaatatgctttttgcagtggcagtatcatagccaatgaggtttagccaaggtgtggatattgctaattggaaacttcccaataccccgccccgaagacttgcaatatagtcggcattggcaatttttgacagtctatgaagactgaatattaaagaaaaaatacagagaaatctcatacttttaatacaatcagggtttcacattgatgaaatcccccctttttttgaagtattgttttgatgcttctgttttttcatatattaatatataagaacatctttttaactcatcctttttaactggttcatgatattatgtagcattgttcagcccttccccaactgatggctgcctaggttgtttcagatactgtgtcgtcaattcccatgtatatatttacttgtgaattttggccctatatactccccttggcatgattccattactgtgctcctcaacaaggccaatcatctggctttcttcagactccacttcctcatgtcccagaccatattcaactcaattcaatttggtgtttgtcactcctgtgtctttgggactgctcttaaccagaccactgatgaataataatcttgccaaaccagcaatcacttctctgccctctcctgtgactttctagtgaaacccacaatttcttcctctcactctcttggtttttctttttctttctttctttttttttaagatggagtctcactctgtcacctaggctggactgcagtggcacgatctcggctcactgcaacctctgcttcctgggttcaagtgattctcctgccttagcctcctgagtaactgagattacaggcatgcaccaccacgcccagctaatttttttttttttttttgagacggagtctcgctctgtcatccaagctggagtgcagtggggcgatctcggttaactgcaacctccgcctcccgggttcaagcgattctcctgcctcaggctcccaagtagctgggattataggcatgcaccaccacgcccggctaatttttgtatttttagtagagacggggtttcaccatgttggtcaggctggtctcgaactcctgacctcgtgatccgcccgccttggcctcccaaagtgctgggattacaggcgtgagccaccgcgcccagcctaatttttgtatttttagtagagatgaggtttcaccatattggccaggctggtctggaactcctgacctcgtgatccacccatctcggcctcccaaagtgctgggattacaggcttgagctaccacgcccggcctctcgttttttttttttttttttttttctccatctctggctactcctccacttgtatcaaacttccaaatattagaatatccttgggtataatcctgtctgatcctctcttcctaagtgacttcctcttctcctgtagccttaattattgcaaatatttggaagatcctctaggccttcagcttagacctttctctggaacaccagactcaaacgtactgtaatgacctgtttgacattcatgtgggtgtcacatactgcttatccatccaaacagatttgttctatttcctttgctcagatgctcccccactgtctccttcatctcagccaatggcatcacaatacagtttgtggccaggcgtggtggctcacgcctgtaatctcagcacttttgggaagctgaggtgggaggattccttgaggctaggagtttgagaccagtctgggcaagtccctgtctctacaagaaaaaaggtgtcatgcactctcagtcaaagtggaataacagggaccaactttgtcctctcacaggaaacaaccaactttgccccccacaaaaaaaccaaaatacatgaaacaatgatttttttttttttttgacggagtctcactctgttgcccaggcacaatctcacaatggcaagatctctgctcactgcaacctctgcctcccaggttcaagtgattctcctgcctcagcctcctgagtagctggggttacgggcacctgccatcatgcctggctaatttttatatttttagtagagatggggtttcaccatgtaggccgggctggtcttgaactcctgacctcaggtaatctgcccgcctcggcctcctaaagtgctgagattacaggtgtgagccaccgcgcccggctgaaacaatgatttttaagacattagacatcaggcaccaaaggacagtgatccctgaaagatgggaaacaacgtgagcactacaactgtcccagcacactgcctggagagcttccatgctatggcactggaacgggaaactgaggcagcgcctggtggactccctaagttgaggtggtccagagagacaagggcagctggagttaaaaggacagaatgtcagcagagaggagcacagagaatcacagagatctgcagagggtcccccttcagtatttagcggagtgcttatcaacacatgcatatgaggcagctacctaaggccaggaaaagaaccatccaaatggattggagggaacaggtcctgacactcacatggagcttctgaaaatagtgcctgcacccaccaaccagactggaaaactcataattcacagggcatagagtacacaggaatgtcttgtctcagttgtggggagtaactagccctagacttagtattgctccaggctcactttacacatcataaaagaagaccctaaaagatccttaggaataacaaagattgataagaattaaaaaagacccagctcctaaaaaggtaaagttgacaatgtctgttatccaaacaaagattaccaggcataaaaagaagcaggaggctgggtgcagtggctcatgcctgtaatcccagcactttgggaggcggaaggtgagcagattgcttgagcccaggagttggagaagagcctgggaaacatggtgaaaccctgtctctacaaataattttaaaagttagctgggagtgatggcgtgtgcctctagtcccagctactcaggaggctgaggtgggaggattgcttgggcccaggaggccaagattgcagtgagccatgatggggccattgcacttcagcctgggtgacaaagagtgagactctgtctctaaaaataaatacataaataaaatggacaatattccaatgacctagtaatctgtggaaagttggatgaaagtttaggtattccagacttgttcaaattaattgtatctatatctcagagaaaatcttcctcaaaacatgattttttttaattggggagacagcttccaatgtaaactgaaagtgcacacccaaaacacaaatatctaaggtaaaaattactctgctcagacccagttgagccagctttaatattagtgtccctcctttattaccacaaaggggtcccaatccagaccccaagagaaggttatttgagatggagtttcactcttgttgctcaggttggagtgcaatggcgtgatctcggctcacttcaacctctgcctcctgggttcaagcgattctcctgcctcagcctcctgagtagctgggattacaggtgcgtgccaccatgcccggctaatttttgtatttttagtagagacggggtttcaccatgttggtcaggttggtctcgaactcctgacctcaagtgatccacccacctgggcctcccaaagtgctgggattacaggcatgaaccaccgtgcctggcccaacatctctttaaacaactgcccctgggcatgggtgggtgggtggaggatgtgactgagctgagatgctcctttctctctgggactgataaattttgcatactttacatagctcagactgcccttgggctatttgtcttttctcttttttttttccccgaggcggagtcttgctctgtcgcccaggctggagtgcagtggcacaatctccgctcactgcagcctccgtctcctgggttcaagtgattcttccgcttcagcctcctgagtagtggggattacaggcgtgcaccaccacgggggctagtttttgtatttttagtagagatggggtttcactgtgtcggccaggctggtctggaactcctgatctcaaatgatctgcccgccttggcctcccaaaatgctgggattacaggcgtgagccactgtgcccagactcctttttttcttttttagagacagggtctggatcctcctgtctctgcctcccaaagtgctgggattacaggcataagccaccgctcccagcctagttttattttctcagtgcaaatttaggagccatcagtatactgtttttgtttttttgttttttgttttttttttttaaagataaagaaggctgggcatggtggcctacacctgtaatcccagcactttaggaggccaaggcaggcagatcacctaaggtcaggagttcaagaccagcctggacgacatggtgaaagcccgcctttactaaaaatacaaaattagccgggcatggtggtgcatgcctgtaatcccagctacttgggaggctgaggcacgagaatctcttcaacccgggaggcagaggtttgcagtgagctgatatcgcgccactgcactccagcctgggcaacaagagcaaaactgcgtctcaaaaaagaaaaaaaattagctgggtatggtggcacatgcctgtaatcccagctactcgggaggctgaggcaggagaatcacttgaacccgggaggtggaggttgcagtgagtcgagattgtgccactttggtccagcttggacaacagagcaagaccatatcaaataaataaataaataaaatgaaatgaaagagatcacctagcaagtgatgtaaataaagaagaggttctaggactaagacgtgggacattgctaagatatagggctcaggggaaccaggaggaactagcaagactgaataggagaagccatcaaggcaggagcagagccaagagaagattccagaaagtcaaaggaaaaagcatttcaaggacaggtgcggtggctcacgcctgtaatctgagcactttgggaggccaaggtgggaagactgcttgagcagttgctgagattgttttagccggaggttgaggcttcagtgagccatgattgtgccactgcactccaatctgggcaacagagcgagacccagtctcaaaatttttaaaaacacaaaaaatcagtggcagttgtttaacatcatagctggttgagatggtgataagagctggagtaaacaagcaacagaccaaaaagcatgaaaggaaaagctggggaatgagatgtctatgaaaagttctgacacactgctggatatctggaatgccatatgcatgcccatgcatagggctgtgagcatgcccaagaaagaaccaagaaaaggccgggtgtggtggctcatgcctgtaatcccagcactttcggagggtgaggcgggtggatcacttgaggtcaggagtttgagaccagcctggccaacgtggtgaaatcctgtctctactaaaaatacaaaaaaagttagctgggcgtggtggcgtgtgcctgtaataccaggtactcgggaggctgaggcaggagaatcgcttgaatcctggagatggaggttgcagtgagctgacatcacaccattgcactccagcctgggcaacaagagcaaaactccgtctcaacaacaacaacaacgaagagaaccaagaaggccttaagctcttatttgtgggggaccttcaggctttgggcaaggaaaaagtgaaggctaaggcacagttgtgaactacctgagggagtgttctaggtattctccaacatacatggacacacattaggcaaatgctggaagaagtaatggttcaaggcatttaagggaacctttgcctaaccgttatctggtcagtaagctaatgaagcagggccttcagtggccacacacaacaaagaatacacactttatagaattagttcagaaaagttgctaaacaggctcatagtagctcatgcctttgggaggctgacatgggaagatggcttgaacccaggagtttgaggtgcagtaagctatgatcatgcactacaatccagcctagacaacaagagggagaccttatctcagaaacaaacaaacaaacaaaaagaagtcactaaacagcagtgataataaaaacaaacagcagccacaacaaaccctgggaaggagacaatctgaatttcagagttgccacattatttaaaatgtccagattaaaaaatgcaaagaaactagaaagtaggccagacacagtggctcacgcttgtaatctcagcactttgggaggccaaggtgggtggatcacctgaggtcaggagttcgagaccagcctggccaacatggtgaaactctgtctctactaaaaatacaaaaattagctgggcgtggtggcgcacgcctgtaatcccagctactcaagaggctgaggtggcagaatcacttgaactcaggaggcggaagctgcagtgaggcaagatcatgccactgcactccagcctgggtgacagagggaggctccatctcaaaaaataaataaactagaaagcatagcccatacacaggaaagaaaaaaagaagaaaaaaaccggtaaataaaaacttccactgaggaagctcagatgttggaattactagacaaagttttttttgagacagagtctcactctgttacccaggctggagtgcagtggtgtgatctcagctcactacaacctcagcctcctgggttcaagcgattcttgtgcctctgcctcctacgtagctggaattacaggcatgtgccaccacgccccactaattattgtatttttagtacacacagagtttcgccatgttggccaggcaatatagtgagaccccatttttacaaaaaagtagctggccatggtggtgcatgcctgtagtcccacctactcaggaggctatggcaggaagatcgcttgagcctaggaggtggaggttgcaatgagctgagatcgggccactgcattccagcctgggtgacagagcaaaaccttatctcaaaaaaaaaaaaaaaaaagaaaagaagagaaaaaaagaagtactgtacttatacgtgtggtacaacatggatgaaccttgaaaatattatgctatatgaaataagccagacacaataggccacatatttttatgattaatttatatgaaaaaccaagataggcaacttcatagagacagaaaatacattcgtggtttttaggagctaaaggctaggggatgggtggaatagtgactggtaatggctatggggtttcctttagaggtaatgaaataaaggaataaaggtttttttttttgagacaggagtctgactctgtccagcctggagtgcagtggtgtgaacttggctcactgcaacctctgcctcccaggttcaagcgattcacctgcctcagccttccgagtaactgggattacaggcgcctgccaccgcgcccggctatattatgtatttctagtagaaacgggatttcatcatgttggccaggctggtccggaactcctgacctcaggtgatccacccggctgtgcctcccaaagtgttgggaatacagacatggccaccacacccggcccaaaataaagcttcttgaattagatagtgttgatgtctgcacaatcttgtgaatgtactaaaaaccactgaattgcacactttgaagaggttggttctatgatatgtacatcttaccttacaactataagaaaaggaatgacctattgaaacatggaacaaacctggtgaatctccaataatttttttttttgagatggagttttttgctcttgtcacccaggctggagcaatggcacgatctcagctcactgcaacctccgcctcctgggttcaagcaattctcctgcctcagcctcccaagtggctgggactacaggcacccgccaccatgcccagctaatttttatatttttaacatgggcagagtttcaccacattggctaggctggtgttgaactcctgacctcaggtgattcacctgcttcggcctctcaaagtgctgggattacaggtgtgagccaccgtaatccaggccttttttttttttgagacggagtctcgctctgtcacccacactgaagtgcggtggcgcgatctcggctcactgcaacctctgcctcccaggttcacgccattctcctgccgcagcctcccaagtggcgcccgccaccatgcccagctaacttttttttgtatttttagtagaggcggggtttcaccgtgttagccaggatagcctcaatctcctgacctcgtgatccgcccgcctcggcctcccaaagtgctggggttataggtgtgagccactgcgcccggcttccaataacttttatagagtgaaagaacttagagagagctagtcttggtggctcatgcttgtaattccagcactttgggaggctgaggcgggtggatcacttgagctcaggagttcaagaccagcctggccaacatggcaaaaccccatctctaccaaaaatacaaaaattagctgggcgtgatggtgcacgtctgtaatcccagctacttcagaggctgaggcaagagaatcacttgaaaccgggaggtggaggttgcagtgagccgagatcgcaccactgcactccagcctgggcgacagagcgagactccgtctcaaaaataaagaaaagaaagaaggaattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgaggttgcgccactgcagtccgcagtccgacctgggcgacagagcgagactccgtctcaaaaaaaaaaaaaaaaaaaaaaaaaaaaaagaaggaatttagaagagttcatactaagatgcacttatataaaactcttaaaaaggcaaaatatgccaggcgcggtggctcacgcctgtaatcccagcactttgggaggctgaggcgggtggatcacgaggtcagtagatcgagaccatcctggctaacacggtgaaaccccgtctctacaaaaaattagccaggcgtggtggcacttgcctgtagtcccagctactcgggaggctgaggcaggagaatcgcttgaacccgggaggcggaggttgcagtgagcgagaccacgccattgcactccagcctgggcaacagagcaacactccatctcaaaaaaaaaaaaaaaaaaaaaaaaaaggcaaaatataacaaagtatattttgtacactttgttatattttgtatactttgttatattttgtatgctatagtaacaaagcagatccgtggttgcttggggatgaggtggggcagttaggaagggaattacaaaggggcatgaggaaacttggagatgatgatatgtccactatcttgattatggtgatggtttcatgagtgtatgcatatgttatttttttcaaaacaaatacctaacacttctgtttcttggaccaattttttttttaacttgccctgcccccaccacctgcttggaccaaaatataatacctatttatgtcctaaaaaaatagtagcagtttagaaaatcgacaacacatagatagaaaaaaaaattgttaaataactacaattgcttattaatggatgcatgtttgttagactctgcacaccttcccaaaccttaatcagattgtctgatatcacctaaatcactttatccatgctgatttttgtcaggtgtttgctttttatcacagaaactgctgtaaacccagctttgcaaaaagatgtcattgaaagaaaagtagttcaatgtaactttgaaactttgaactcccttgaatagtttatgaggtatctgacatgttgagtacccatatatttccctcaaacaatttaaagcatcttacagcgtccctgagaattcactatggcactctgaggtgcctcaacacagtttgggaactgcaatcctaactcacgcaggtctgtgtttcctcattctgtttcttttcacttagtattatggtttttttgttttgttttttagagggagtctctgtcacccaggctggagttcagtggcgccatctcggctcactgcaacctccgcctcctgggttcaagccattctcctgcctcagcctcccaagtagctgggattacaggtgcccaccaccatgcctggctaatttttgtattagagacggggtttcaccatgttggccaggatggtctcgatctgacctcggcctcccaaagtgctgggattacaggtgtgagccactgtgcctggccagtattatgtttttaagctggatactttgttttcttttaatagagatggggtcttgaggtctcactatgttgcccaggctatattttttttgagacggaactttgctcttgtcacccaggctggagtgcaatggcacgacctcagctcactgcaacctccacctcctgggttcaagcaattctcttccctgggattacaggcttgagccgctgagcccggccagcccaggctaatcttgaaccactgggctcaagtaatcttcctgtctcagtcttccagagtgctaggattacaagcgtgagccaccacaatcagccttcttttttttttttttttttaatgagtcagggtctccctctgtcacccacactggagtgcagtggtgtgatcatagttcactgcagcctgcagcctcgaactcctgggctcaggcaatactcccacttcagcctcccaagtagctgggactacaggcacacttcaccatgcccagctttttaaaacatattttttgtgaagatgcggtctcattatgttggccaggctggtctcaaactgccggactcaagtgattctcccaccttgttccccaaagtgctgggattacaggtgtgacccaccttgcctggcccggggtgtcttttttttctgagatggagtctcactctatcgcccaagctggagtgcagtggtgtgatctcagctcactgcaacctccacctcctgggttcaagcgattctcctgcctcagcatccccagtagctggaattacaggcacacaccaccatgcctggctattttctgtatttttagtagacacaaggtttcaccatgttggccaggctggtctcatagggtgtctttaactagcatggaacccacaaggtccactcattcatttttgtattacctcccaggctcagcatggtgcctgaacctctataaggaggcaatgtgtgttaagagagacaggaggggtcaggtgcggtggctcacacctgtaatcccagcactatgggaggccaaggcaggcagatcacttgaggccaggagttcgagaccagcctggccaacatggcaaaatcccgtctttactaaaattgcaaaaattagccatgcgtggtggtgtacgcctgtaatcccagctatttaggaggctgagacatgagaattgcttgaacccgggagtttgaggttgcagtgagctgagatcgccccactgcactccagcctgggtgaaaaaataagactgtttcaaagaaaaaaaatttttttttttgtagagacggggtttccccacgttgcccaggctataactgtactttaaaagacacaatactctagagatgtcattacagttagtagattattatcttaattgaccctaaattcgctattttggagctaagcaaccaattacggcctggtggtatattcacctgctccttagatggaggttctgtgaaggcagcagctctgtccatgttgtttactgtagggctgaacactgaccttgagacatagttggcactcaaaattatatgttgaatgacagaattttgattaggtggatctaacgcatttgaaataattcatagggctgggcacggtggctcaagcctgcaatcccagcactttgggaggtggaggcaggcagatcgcctgaggtcaggtgtgcaagaccagcttggccccagcctccctagtagctgggattacaggcatgcaccaccacgcctggctaattttgtatttttagtagagatggagtttctccatgttggtcaggctggtctcaaactcccgacctcaggtgatctgcctgccttggcctcccaaagtgctgggattataggcatgagccaccgagcccgaccatcctggacatctcttaacccagctttccctctgcaaagggagcatgcatttcagtgaaagtttagaagaattacagtgatatcactttcatgaatcaaaattggctacttgacttcagtaatttgtgaaaattactgttgcggctgggcatggtgcctcacacctgtaatcccagcactttgggaggacaaggtgggaggattgcttgagcccaggagttcgagactggcctgagcaacatggcaaaattccatctctacagaaaatacaggctgggcacggtggctcacacctgtaatcccagaactttgggaggccaaggcgggcgagcctcctgagtagctgagactataggttcacaccactacatccggctaattttttttttttgagatggagtcttgctctgttgtccaggctggagtgcagtggcacgatctcggctcactgcaacttcttcctcccaggttcacgccattctcctgcctcagcctcccgagtagctgggactacaggcgcccgccaccacgcccagctaattttttgtatttttagtagagacggggtttcaccatgttagccaggatggtctcgatctcctgacctcatgatcggcccaccttggcctccaaaagtgctgggattacaggtgtgagccaccgtgcccggcctttttttttttttttttttttttttgaggcggcatctcgctgtcacccaggctagagtgcaatggcgtgatctgggctcactgcaacctccgcctcccgggttcaagcaattctctgcctcagcctcctgagtagctagaattacaggcgccagctgccaagcctggctattgtttttgtatttttttttttagtagagatagggtttcaataagttggccaggctggtcttgaattcctgaccttgtgatccacccacctcggcctcccaaagtgctgggattacaggcgtgagccaccctgcccggccaagttttacattattaagctatccatgttctcttgggaactgaactttttttcctcttgatgctctggatttgacattgcacttgactttttatgtagtaactgacatgtgccagagttggcatcttcccccaagtccaagcatcatgagtaactcttgcttatctctctctctctcttttttgagacaggttttgctgtcacctaggccgcagtgcagtggcgtaatcatggctcattgcagtctcaacctcctgagctcactcaatcctcccacctcagcctcccatgtagctgagactacaggcacgcaccaccacacccagctaaatttgtttatttttgtagagactagatctcactatgttgcccaggctggtcttgaactctggagctcaagcgatcctcctgtctcagcctcccaaaatgttggcattataggcgtgagccactgcaccctgccttgcttatctttatagattcaaatggtaggcatttcccatcacctaattcctttttttgttattgttgaatagggtcttgctctgttgcccaggctagagggcagtggcccaatcacagctcactgcagcttcaatcttttggactcaagtaatcctcctgcctcagcctcacaaagtgctgggattacaggcatgagccaccaggcttggcaagtgatgatattttttatttttattttttgagactgagtttcgctctgtcgccaggctggagtgcagtggcacaatatcggctcactacaacctccgcttcctgggttcaagcgattctcctgcctcagcctctcaagtagctgggactacaggtgcacaccaccatgctcggctaataagagatggggttccaccatgttggccaggatggtctccatctcttgacctcgtgatccgcccacctcggtctcccaatgtgctgggattacaggtgtgagttactgcgcctggccagcaaatgatgaaattcttataatttaaatggctacagacttaaaaggcaagctatatacattgaagcacttttttttttagcatttgtacttttcaaatagacccattcttttattaataagctaaagattttcttttcctcccccatcttctttatttgtaaatacttttgggtgtgtttcttttagttaagtatgcacaacagataagaaagggtgtgtttctgttatttatttgagatggagtttcacttttgtcgcccaggcgcccaccactagccccagctaattgtttttttttttttttttgagacagagtctcgctctgtcgccaggctggagtgtggtggcgtgatctgggctcactgtagccttcacctcctggttttaagcgattctcctgtctcagcctcccgagtagctgggactacaggcacgtgccaccatgcccagctcattttttgtatttttagtagagatggggtttcacaatgttggttaggatggtcttgaactcctgacctcaggtgatctgcccgcctcggcctcccaaagtgctgggattacaggcatgagccaccgcgcctggcctcccccagctaatttttgtattattattattattatttttttttttgagatggaattttgctcctgttgcccaggctggagtacaatggcgcaatctcggctcactgcaacctctgcctcccaggttcaagcgattctcctgtctcggcctccagagtagttgggattacaggcgttagccaccacacctggcttattttttgtatttttagtagagatggggtttcaccatgttggtcaggccggtcttgaactcctgacctcaggtgatccacctgccttggcctcccaaagtgctgggattacaggcacgagccactgtgcccggcctatttatttattttttgagatgaggtctctgttgcccaggctggagtgccgtggtgtgatcatggctcactgcggcctctaattgcaaggcttaagtgatcctcccacatcagcctcctgagtagctgggaccacaagtgtgtaccaccaaactgggctaattttttgtaatttttgtagagacggtgtctcacattgcccagactggtctcaaactcctggcctcaagtactctctctttaaaaaagataatactgcagggcgtggaggctcatgcctgtaatcccagcactttgggaggctgaggtgggcggatcacttgaggtcaggagtttgagaccagcctgaccaacatggcaaaacctggtctctactaaaaatacaaaaattagccaggagtggtggcgagcacctgtaaatcccatctactcgggaggctaaggtgcgggaattgcttgaacctgggaggcggaggttgcagtgagtcaagaccgtgccactaaactccagcctggacaacagaaggagaacctatcttaaaaaaaaaagaaaaaaaaaggtaataaaggctgggtgcagtggctcatgcctgtaattccagcactttgggagtctgaggcaggaggattgcctgaacgcagaaatttgagaccagcagggcaacattgtgagacctcatctctacaaaaagtaaaaaattagccaggtgtagcgtggcgcacctgtactccaagctacttggggggctgaggtgggaggatggcttgagcacaggctgtccagactgcagtgagccatgacttcaccattatactccagcctgggtgacaaagaaataccctgtctctacccccccaccaaaaaatgagttaatatagcttattgtatgtttggttatactgtaatctttagaacaaaatcccaaacaaaaacaatgcacccctcacttcctatggcatctgagtggcgaaactgaagtatatacaaagtattatatgaaacggaagtatatacaaagtattatacaaaagtgaagtatacatgttacaaagccagccactctcagaaacatccagaggaggggcctggcacagtggctcatgccagtaatcgcagcactttgggaggcccaggtgggtggattacctgaggtcaggtgtttgagaccatcctggccaacatggtgaaaccccatccctactaaaaatacaaaaattagctgggcgtggtggtgcgtgcctgtagtcccagctactcgggaagctgaggcaggagaatcgcttgaacccgggaggcagaggttgcagtgagccgagatcacaccactgcactcctgcatggcaacagagtgagactccatttcaaaaaaaaaaaatccagaggtgactaattgcccggacttcaactgaacctttgaagagtgctacccagtactccagttcccacacactcacagttaaaatagcaacctttttcctcattcctgagaaaagagggataaaataacaatctaagagaaaaggaaagaacaatgtttctggggcgggcgtagtggcttatgcctgtaatcccagcactttgggaggctgaggcaggcggatcacgaggtcaggagatcgagaccatcctggctaacacggtgaaaccctgtctctactaaaaatacaaaaaattaaccgggcgtggtggcgggcgcctgtagtcccagctactcaggaggctgaggcaggagaatggcgtgaacccggaaggtggagcttgcagtgagtcgagatcgcgccactgcactctagcctgggcgacagagcgagactatgtctcaaaaaaaaaaacaaaaacaaaaacaaaaaaaaacacacagtgtttcttgggaccagacctgatatcaacgttgtttcttgggaccagacctgatatcaacgttgtttcttgggaccagacctgatatcaaggttggctgttttcagcagtggaggcagcactacgctattggagtttctaagctaattaagggaattttttcccacttagtgaaagctggggcctcagggctcaggcttcctaacattttgggcacccagttaaaagatcaacagtcccctgtcccttcagcatgtgactcaccccagggcaatgaactgggcccacggctccatctgcatctatatccctgtaaatcatggatttatacatattggtgcatacgtttataatgcttgcaatatatacttccatttcaacttacatatatataaaatgtaacaatttcttttctttctttttttttttttttgagacgtagtttcgctctgtcgcccaggctggagtgcactggcgcgatctcggctcactgcaagctccgcctcccgggttcacgccatcctcctgcctcagcctcctgagtagctgggactacaggcgcccgtcaccacgcccggctgattttttgtatttttttagtagagacggggtttcactgtgttagccaggatggtctcgatctcctgacctcgtgatccacctgcctcggcctcccaaagtgctgggattacaggcgtgagccaccgcgcccggccaaaatgtaacaatttcaacctgtaaaaagataagtggtcaccttacctatgatgtggattaaataagacgtgtcaacgcagccatcctgccccatccgaccagaccttaatgctccaaaaccatcagtttgcgcctggaaaactggggaaagtgtttattcccttacacaggcttcgccaaaggccctgacacttagggctttttcactgctgcaaacgttggaccggcttgtgagaaggagtacagttaatctaactttggtatactgtatccagagaccacagagggctcgctctgcgatttatggtgcgaggaagaccagacacccgctgtgcccgtcctactcctgcagatcaaactcaaagccacactttccggagtgagaaacgggacagtaaatgaacgcaggaaccacggtgcgcaggcacagaaccccgctgggtttgctacgaaggttgaggtggaagcgcccagcgcaccaggcgccacggcccggtgtgtgacctcactaacctccaccagcgcgcaccctgtcctgccccttcacgggcgaacaaccccacacgaggcagtggtgtgggagccagtacccggaaccgtaaaagcacgactttcccggagcccaggcactgaatggcacccactgcgcatgccccagagcggcgacgaatgggagcccggagcgcaggggcggaggcgcgcccgggcagctaccgagaagcgccaatcaaccatcgaccaatcagatcatcaccgtcaatcgtcatcgaccaatcagagcccaccgcgccccggccttaagccagttgcttgttccgcggcgggagggttgggtcaagactaagccttcgggggagagggcaacgcggtgggcgggagagaggccgagggccgctcgggtctgggagtgccaacaggacgggatgggcacgagcatgccgggccccgcgcgggggaggggctctttccttaccccacacaaaaaggtgtgcccgggttggctgcccctgcccagtgttgtggctccatgtggacgctttcgtgcgcgcgtccctgccccgcgcgcggcaggccattccaggctgtgggctgcgggctctggggtccgagggtcggacacgctggggagtggacacccctagggtcacacagacagggctttggacacccacaggggcacacacattggggagtgggcactcctggggtcacacagaccgaggtgcagggatgtagggggcgcccgtccaggggtagttggtggtggctgagggtgagggcaaggtaaggactgggaggagatttctggttccctgactgggccagggttttcctgtgcaggtgaggggagtaggccggggcctctcgttggtggggagggctccaggagcctgtcccaaccctgcaggcctctggctgagcctcacagaagggagctctgagatgggctgtgcagcaggggaaagaaaaagagaggtcggtcgcctgttctgggttcttgaccatccaccagtggtggtggagcctggaagtctgagggaggagggtgaggaggcgcttgagggacggggggaatctaggcgtcaggaatgatagttcgttgatccaaattacccagtaatggataattttaacacgtgccaacctctcctgattacgtgaataatttcactgcgtcttcacaacaaccttaactactattatcatcgttgcgttctggatgagagacctaaggccctgtaggggttaccagaaggcacacagctgagcagagccagggccagggtcaggctgtgcactctggactctgtgttctgaccatgcgtcactgactctacagatgtctctcctttctgtgctcaccctgtcctcattccgcccccggcaggacagagggcccctgaagcatccatttgcccacagcatcagtgaactgtgtagaactctctgtgcaagggagctggcccctgtgcaccctgagtcgtttttcttctctggctccccacgcaggggcagtgaacagaggacagggaagctttgtaggaagagggcagtaaatcacagcatagttatccagactgcaattatttacttagtgcattcagggtcttgtattaggtggtggggattccgcgctgaaccagacagacaagggtcctgttcctgcctgccctcggggtgtgttttgggaattcctccttgagggtgctttggcactgaatgggcagaggtctggtgctggggggctgtcccacaccagcaagacttgtaatgtacatgaatgtgaatgtcatttcaggatggtaaaaggaggccttttcttttttttttttctgagacggagtttcgctcttgttgcccaggctggagtgcaatggcacgatcttggctcactgcaacctctgcctcccaggttcaagtgattctcctgcctcagcctccctagtagctgggattacaggcatgtgccaccacgcccagctaattttgtatttttagtagagacagggtttctccatgttggtcaggctggtctcgaactcccgacctcagttgatccacccaccttggcctcccaaagtgctgagattacaggcatgagccaccgcgcccggccgaaatgtttcttactaaaagggcgtactggatctgagggttgggaaatgacacttccttatgtcaggcctgtcccaggaagcaccccgcagtcgggtacggagggccatgaggatagtacggtgaggggaggaagaggatatagcaacgtaaattttgccatcttggcctcagtttggttttaaaggacagcagctggaccttccctatgtgtaggactcaatcagtggggccagggtgtggaagacagccctgtgtcttattacctactcagggcctgaggtgtggcaaccaggatcttgcagggaatgccttcccaaaaagaagcaaaatacagaagatataaacaggaagccaggcatagtggctcacacctgtaatgcaagcactttgggaggctgagatgggaggatcccttgcactcaggagtttgagacccacctaagcaacacagtgagaccctgtctttataaaaaaattttaaaaattatccgggtatggtggtgtgtgcctgtagtcccagctacttgaggggctgaggagggaggattgcttaagcctggaagttcaaggttgcagtgcactgtgatcatgccagtgcactccagcctgggtgacaaagcaagaaccctgtctcaaaaaaaaaaaaaagatataaacaggaggtgattcatctggtgcccctggaggttggagacgaaggtgatggggtctatcccagttcttgggcgttcctggtgtttactgtgtagtaaattacttctgcttccagctgtgcagacaagcaaacagaaaagctggattaaagctgctgtttttaagtctatttgaaggcccaggagagcaaattatctctgaggtattacctcaccaaatactggcatccagtgcagaaaagcaagagttgatggagacacataaaaaacaaacaagctcggctgggcacagtggctcacgcctgtaatcccagcactttgggaggctgaggtgggctgatcacctgaggtcaggagttcgagaccagcctggccaacatggtgaaactccgtctctactaaaaatacaaaaattagctaggtgtggtggcgggtgcctgtaatcccagctactcgggaggctgaggcaggagaatcactttaacctgggaggcagaggttgcagtgagctgagatcgtgccactgcactccagcctgggcaacagagcaagactctgtctcaaaaacaaacaaacaaaaaccaaaacaacaaacaaacaaaaaacaaactagctctggccggacgtggtggctcacgcctgtaatcccagcactttgggaggtgtgtggatcacccgaagccaggagttcaagaccagcctggccaacatggtgaaaccccatctatactaaaaatacaaaaaattagtctgtcgtggtggtgtgtgtgcctgtggtcccagctactggggaggctgaggtgggaggatcacttgtgcctgggaggcagaagttgcagcgagctgagattgtgccactgcacttcaatctgggtgacagagtgagaccacgtcttattaaaaaaataaatacaaatattagttgggtgtggtggcatgggcctgtaatcccagctacttgggaggctgaggtgagagaattgcttgaacccaggaggtggaggcctcagtgagccgagatcacgccactgcactccaacctgggcaacagagcaagaatctgtctcaaaaaaaaaacaaaaacaaaaaacaaaggccaggcgcagtggctcacacctgtaattccagcactttgggaggcccaggcaggtggattacttgaggtaaggagtttgagaccagcctggccaacatggtgaaatcctgtctctactaagaatacaaaaattagctgggcatggtggcccatgcttgtaatctcagctgctccggaggctaaggcacaagaatcacttgaaacccaggaggcagaagttgtaatgggccgagattgcaccatggcactccagccttggcaacagagtgagactgtctctaaataaataaatacatacatacagacagacatacatactagctccaaattactgatgccaatcaacagtaataaaaaatatgaatgatatgaaacgtgatattaaaatgattagtaaatcactatagtccataatgggaaaactcattccattatgtactaaaataacaaaaatcgggccaacactttgggagactgacgtgggcagatcccttgagttcagaggttcgagactagcctgagcaacacagcaaaatttcatctctacaagaaatataaaaattagccaggtacggtggaacatgcctgtggtcccagctactcgggaggctgaggtgggaggaagaggatggcttgagcctgggaggcggaggctgcagtgagccgagatcacgccactgcactccagcctgggcaatagagccagaccttgtatttttttttttttttttttaaatcattctcataccttgataaggaaatacgcaacttttaaatgttaatttagaaaataaccagcaaatgtagcagatttttagtgtcccctaaattagtgttcaaggggatcaatctggacgcagagaaagaagtaaaaaaatggagaacaggccaggcacagtggctcacgcctgtaatcccagggctttgggaggttgacggagccggattgcttcagcccacgagttcaagaccagcctgggcaaaatggcaaagcccaatctctatggaaaataaaaacttttaaaaattagcccaccatggtggcactggcctgtagacccagctactcaggaggctgaggtgggaggatcccttaagcccaggagttggaggtggcagtgagccatgattgcgccactgtactacaacctgaatgatggtgagaccctatctctaaaaagaaaaagaataattttatcttggcccccatgtggcacctcacagcttgggaacaacaatttctcacgtttcctcagctccaaccaccactcacaagctgtgtgacctcgagcaaggcacccaagctcctctggacctcagcttccctgtcagtacaatggggataacaatagtgcttactttatggggtcatttgtgaatgtgagatgagttaataaatggaaagcacttagaaaaacctctggaaccactgaatcaaactggatatcattattgatccctcattcaatccttcaatacccatttagtgtcgtctgtccagatgctgcagatacgcctagcacacagtgactgctcagcgaacagtgtcacaatgaacatgtgcaatggccttgaaggccacattgggacttgccctgatcagcaggttggaggtgctccaggcccgaagcttagctgtgagtggggacatgggagggaggttggaactaccactgcagaaggggctctgaacctaggttcaggagagaggctttgaacttgcatgtgtggggagccatggaagtttccaggaaggactgcaggtcccacctggagatgtgcagttcctccttcaggtacctgggaatgtcagtcacaccccagacctgctcagctcctccaaactgctgttcctgtatctgagagcttcaagtccccaaatggcctatctaatacatggggaaactgaggcctggggaggcctggggactgagctagcattcacttgtggaaatagtctggcatcacctgaagaagttagagacatgcaaatcctacgtcctcagattcccctctgagagtctgcgtgcctatgtgaaccaggagacatgtgcgggagtgaacactgcagtgttactccaaacagcaagaaccagaaacagcccaaagggccgttacaggagaatatggacacccaggctgcacatgcacaccatggaatgctgtatggcagtggaaataaatgaacagctacccctacaggcaaacaggaatcacagcaacagctgggagtgacggcgtgaagcagagggacaagaatgtgcactcatgcccggtctgcctggcttacaatcctggctctctgcttgccagctagaactatcatgcaaatcatttaaccactcggtgcctcagttccctcatatgtaaaatggacatggtaacagtgtgtatcccacaggccattatgaggatttaaatgatttaaaggattgtgggctgggcacagtggctcaagcctgtaatcccagcactttgggaggccgaggtgggtggatcacctgaggtcaggagttcaagaccagcctggctaacatggtgaaacctcgtctctactaaaaaatacaaaaaaaaaaaaaaaaaaaaaaaaaaaaaaattagccaggtgtggtggcaggggcctgtaaacccagctacttggaaggctgaggcaggataatcacttgaacctgggaggcagaggatgcagtgagctgagatcgtgccactgtactccagcctgggcaacagagtgaggcttggtctcaaaaatataaataaataaacaaacaaataaataaaggattgtgaatgtaaaggggacagaacagtgcctgacacacacatcaagtgctacatgagtgttaagagaaagccggctgggtgtggtggctcacgcctgtaatcacagcactttgggagactgagatggacggatcacctgaggtcaggagttcgagaccagcctagccaacatggagaaaccctgtctctactaaaaatacaaaaattacctgggtggcgggcacctgtaatcccagctactcgggaggctgaggcaggagaatcgcttcaatctgggaggtggaggttgcagtgagccaagattgtgccactgcactccagcctgggtgacagagcgagactgtctcaaaacaaacaaaaaaacaaaaagaaaaccagaagccgggtgcagtgattcatgcctgtaatcccagcactttgagaggctagggcaggaggatcgcctgaggccaagggttcaagaccagcataggcaacatggcgagactctgtctctattaaaaatttaaaaattagccaggtgtggtgggatgcacctgtagtcccaactactcaagaggctgaggggcgaggaatacttgagtttgaggcagcagtgacctatgattgcagcactgcactccagcctggacaaaagaacaagaacctgtctcaaaaaaaacaaaaacaaaaacaaaaaaaagataaatctagaatgtccagtggggaaaaagtaagtttccaaagattacatagtgttatggtttgatgacttgtacctctcaaacccagcactttgggaggccaaggtgggtggatcacctgaggtcagaagtttgagaccagcctgaccaacgtggtgaaactccatctctactaaaaatacaaaaattagccgggcatggtggcgggcacctataattccagctactcgggaggctgaggcaggagaatcgcgtgaacctgggaggtggaggttgcagcgagctgagatcgtaccattacactctagcctaggtgacagagcactactctgcctcaaaaaaagaaaaagaaaaagaaatgtaattgccattgtaacagtattaagaggtgagatctttaagaggtcatcaagcaagcaagagagagagagagagagagagagagtctttttctaccacgtgagaacatagtgaggtaatctgcaagccaggaaaagagtcctcatcagaaatgaccctgacagaccttgttctgggaattctagcctgcagaactgtgagaaaataaatttctgttgtttaagccaaaaaaaaaaagtggtaatcaagaggcctcatgaatggattactgctgttattatgggagtggggagtgggtttctcataataaaatgggttcagccccctctctggccctctcttactctttccccctccactatggaatgacacagcaagaagaccctggccagatgctgcacctagatcttggacttcccagcctccagaactataaggaataaatttctattctttataaattacccagtgtcatgtattttggtacaacagcacaaaacagactaagatgtatacttttttttttttttttttttttgagacggagtctcgctctgtcgcccaggctggagtgcagtggcgcgatctcggctcactacaagctccacctcccaggttcacgccattctcctgcctcagcctcccgagtagctgggactataggcgcccgccaccacacctggctaattttttgtatttttagtagagatggggtttcaccgtgttagccaggatggtctcgatctcctgacctcatgatctgcctgccttggcctcccaaagtgctggaattacaggcgtaagccactgtgcccagcctaagatgtatacttttatacagttcagaaacaccaaagatgaagcaagatatttaggctgcagactactgacttcttgtattctcacatagctgaaagaggacgagagtctctgggatgccttttaaggcactgatcccatctatgagggctctgcccttgtgacctaattacctcccaaaggcctcacccctaatgccatcacatggggcggttatgatttatttttttttcttttgagatgaagtctcgccctattgcccaggctggagtgcaatggcgcaatctcagctcactgcaaccttcccctcccgggttcaaacgattctcctgtctcagcctcccaagtagctgagattacaggtgcacgccaccacgcctggctaatttttgcctttttagtagagatggggtttcaccatgttggccaggctggtctcaaactcctgacctcaggtgatctgcccaccttggcctcccaaagtgctgggattataggcgtgagccagtgctcctggcctctacaaaaaatttttaaaaaattagctgggcgtggtggcacacacctgtagtcccagctactcagtaggcaggaagattgcttgagcccaggagatcaaggctgcagtgagccatgattgtgtccctgcacaatcagcctgggagacagagtgagaccctgtctccaaaaaaaaaaaaaaaaaaaaggaagccttgctgggcatctaatgggaaaatctgtgttcccaacaatggaaatcagctagattgaccaaagcaccagaggaacaaatgtatttagagtggttctgtgtgcacatggtggggggtgtatggcaagtggggagttgtcaactggcagtctttagcagtggctatatggaggcttctcatgatttccacttcagtcagaacaaaagccatagtagttccagtggactgaccttacagcactacaggatctccctgacctgacctcctaccaccttctccctcacttactcccctgcagccacaccagcctcccggctgttcctcacacatgctagcaacagtgctaccacagggcctttgcacttcatttcccctgtctagaccgctttccccagatagctgcatgaccatcccttacttccttaataccgttgcttaatgtcaccttctctctaaggctttctgtggccatcctattaatactgcccctttcccccatggttctcagcttcttataacatcttccatcacttacttctgcttattgctcactgtctcagccccagtggagtgtcagccccacaagggcaaggatgtttgttttgtttgtagctccatactcggtacccaggatgctgcctggcatatagtagggtcttgatattaagtgatttactccatacggttcccctagcatgcaggatggtacctggcattcagtaggagctcaagagatgtttgttgaatgaattggtgtgataggggacttggtgaggacccgcccccacttagatagctttagaagctgttggatacttcatccctctgcgtggtgctgcagacatggagatgaagaggtggcctcagtgtgggagtagaggggagcattcccttgactgaggaaggaatgttagaaaagagagctgaggctgggcatggtggctcatgtctgtaaacccagcactttgggaggccgaggtgggcagatcatgaggtcaggagtttgagatcagcctgaccaacattgtgaaaccccgtctctactaaaaatacaaaaattagccgggcatggtggcatgcgcctgtaatcccagctactaaggaggctgaggcaggagaatcacttgaaactgggaggtggaggttgcagtgagccaagatcacgccactgcattccagcctgggcaacagagcaagactccatctcaaaaaaaaaaaaaaaaaaaaaaaaaaaagagctgaggccaggagtggtggctcatgcctataatcccagcactttggaaggccaagatgggaagatcacttgagcccaggagttcaagaccagcctgagcaatatagtgagaccttgtctctcttatatttaaaataaaaaattatttaaaaaaatttttttaaaagaagagctgacctgtccatatctgccactgaacacagcccagacagcaacccacagcacctcaataattgactcctctctgaaaggcaaagaaactgcttcctgagtctgctgctacaaattcaaggcttggcatctggacaatttttaacagaagcagacccctgccagggaaacttctgggggcttggcagaagaggcagatgccttttaatctacctcttgctcaatccctgtgatgtgaaaaaagccagtctggacaaattgtacaggtcacagtccccagcttgtgaggggcctgtagagaattctcgggctcacagaagccgttgctgcagtaaccactgccgcaagagcaactttggcagcaggcaggtgccaggcagcaagctgagagaacactgcacagattcaaagtgtcttcagatacaaggctttgtttgtgcacagtgaacaaagggcatattgggaaggcctccttatattgtccacacttccctgaatgtaaggagccctgtcctcaaaatggggatcagcagggctcctttcaaggtaaagcagaaaaagtcccagtggcctgtcaagggagaccaggcgctttggctggagctaggtgttctggacaaagggccatattcaagaactttgggccccattttcaagcgtaggcttaggagaaagatgaattccaggaaatctgaagctgatgagatatctgctttagcattgtggcacggggaggagatggagggtgtctgaaatggccaggttatgttgtgttacaggcagagacagagccccagtgccattccctggggagctttagcccttctcaaaggtgctaccaaggctggtttattatgattggagaaaggaggaggcctccttgacagagtgaagtgcataaagcataggaaatggactactggacatgagaagttgggaacatcctccctacgattaacaaaatacaagccagagaccaggcacggtggctcattccagtgcctataatcccagcactttgggaggctgagacgggaagatcgcttgagcccaggagatcaatgctgctgtgagctatgattgcaccactgcactccagtctgggcaacagaggaagaccccaggctcagcatattctctggggtcctgctctaaactgagagtgaaagcatactctgctgctagttgctagagttcttgctcagaaagttgttcagagatacagtatttcagattccacagcatctaaagatttttttttttttttttgagacagagtctaactctgtcccctgggctggagtgcagtggcgcaatctgggctcacagcaacctctgcctcctgggttcaagcgattctcttgcctcagcctcctgagtagctaggattataggcgtgcaccaccatacctcggtaattttttgtatttttatacttttagtagagacagggtttcaccttgttggccaggctgatcttgaactcctgggctcaagcgatccatccacctcagcctcctaaagtgctaggattacaggcatgcaccactgtgcccaagcttatagtatctatattccaagagtgagctcacaatcaaatgagtcctttaacttgtcctgtaccctgagcagaaaagcaaggcttaaaagtgaaatggttcccacctcagtcaactcagttcccaccttaactcgcagctcatcataccacttatgatttcatctttctattaagtacttgaaatggtttttattataccctaaattttggtaaatattgggtttgtttctagcttccctactggttcacccatccctttcccttgtccttgtcccaggactgcaccagaagtagaggatggaacaatgatcttcccaccttctgaaggcaactttctcatatggtacagaactggtaccagcctgggggatgggaggagtcccatgggtcagtcatcatctgtgtcactagggcccatgtactggcagatggcatcgtagtgaagctccaccacctgattttctcttggcagttgcaccaaagcccggctccgtgctctgtcccggctcagcaaatgtcccacctggaacagaggtgaagtggaatcagcaaggcaagcctagatcctgggacaggccctgaacgacccacaaacctctactgccaggtctgagactcacccttccagtctgtgggcccagcaccaccatcacacggtcaccctctgccttgggaaccagggtctccagcatgtcttccctcaggcctatggataagggagaggggagtgaggcccacagcaaggaccagcccaaccagcgtcctgtcagaagggcctttcctggccaggcgtggtggctcacacctgtagtcccagcactttgggaggctaagttgggaggatcgcttgagcccaggagttcgagaccaacctgggcaagatggtcagacctcatctctacagatttttttgttttgttttttgagactgagtttggctcttgttgcccaggctggagtgcaatggtgtggtcttggctcactgcaacctccgcctcctgggttcaaacgattctcctgcctcagcctcctgagtagctgggattacaggcacccactactgcgtttggctaattttgtatgtttagtagagatggggttttgacatgttggtcaggctggtctcaaactcctgacctcaggtgatccaccctcctcggtctcccaaagtgctgggattacaggcatgagccaccgcgcccagcctacaaaaaattttaaaattagccaggcatggtggtcagtgcctgcagtcccagctactcaggaggctgaggtgagaggatggcttgaaaccaggaatttgaggtggcagtgatccatgatggtgccactgcactccagcataggtgataaaatgagacccaatctcagcatgtcataagatacagaagccaacctgaaagaactcctggtcaggtgcggtggctcacgcctgtaatcccagcactttgggaggctgaggcaggaggatcacgaggtaaggggttcaagaccagcttggccaatatggtgaaaacctgtctctattaaaaataccaaaattagctgggtgtggtagcgggcacctgtagttccagctactcaggaggctgaggcagaagaatagcttgaacccgggaggcggaggttgcagtgagccaagattgagtcactgcactccagcctgggtgacagagtgactctgtttcaaaaaaaaaaaaaaaaaaaaaaagaaaacttgacagactgggagagtggggctcaagataaccaaccaccatcatggaagtgtctaatgttctgtaagaggatgctaggccttgcaaaatacctgaactctgccaaacctcccagctttgcctgggccaggctctgggcctaaaacactcttcttgatcaacctccagctgccatcgctcaaactcaccttccaggactcggccttcatctgtccgacatacacaggtatctgggcttaggacatcttcaattatcatctggggatacaggtcagggggatgtgagattttagagaggtaggggggcccagtccctaggagagggagggggactcaggctgcagggttcccaccttggtgttgtaatattggcctcctttgtacatgttgtccacaaaccgcacacgcaggtccctgtgcaaccagtgctgacttctgggggctgctttctcactcttggctgcaggcccatcctgtctgtggagaaggtgccagcaccaggcttagctcttcatcagatgcactttccagttgccctccctttgcctatgctatgaaacccacccacaatgcagttccccgttccttctatgagcccgccttgccttggaagccttccctggctgctcgagcctacccacagccctgccttcttgacccctcccgcatgctcagagtcccaccggtctggaaggtgtttccgcttcctctctgagttgtcctgctggatgtagagttcttgattccagagggtcttccgtgatgaggcagttccgttctgttgccctggggaaggaagttttgctcatctggcctgttcaagaggttatgaggagaaccaggacagagcctcagtgtctcactgccctttccttccaaggccatgtctcagcctagagccacctcccacctgccaaagtgcccctctcacccctcatgcatttgctagtagaatgcctctcccccacctctcaaccatttcagcttccttcaggaaccctcccgcagccaacctagcccacaacaacaatgctcacctagtgtggactagagattcccagagagctctgtctgtacccatttgccaaactgccccgtcctaccgaaacgccttcgcctgtgctgttctgtctgcctagaattccttccttcttggtcacaccctaatcctagcagttctcactccctagtaaaagagaggttcatcaccccaaatggacaaagatctcgaaggtaggaattggtttctgcacctgtttcttctcactcagacaggctacagacccaggggtatgacatcgacctttctccaatcaaatggagtaagtcacttatgtccattctcacctcctgacctctgattggaagtcatatctgccaggcacactgctgcccctccctgctgcagatctaaaaccaccccattagccaggccctgccacccctaggaatgcgttgccaactcccctagctctacaagaggctcactcactgagatccaaggtgttcttgtcaaactcctgctgggagacaggccgcaggtagtactcactaacagtcaccacccggctccccacagccagacgaaccatggcccgaacattgtcaggatcaaggccttccacctaaagtgttgaggggaagaagtcaggtaggggttgtggactccacccacattcctaggaccaagatgtcaaccccttacctctaagaggcctgcttcctctgtctccccaaccagactctgacccctgagaagtgggaccaggtctggttcctgtgtctccctcagctgactgtggggcttccttggatcctttaagcatttaatcttcagggacttgtggcatatggcattctcttccttttagctgggaactgaggctcacaaaggccagcaagtggtcctgggttactgagtgaggcagtgggccaagcagacctaaaagactaggagtcccagcctttctacctcaaatccaattattcctccatctgaccctcggatcaaccttccctgctgcctgttttgggctcccgggatatcttggttccttaccttcccatagaggcctcggtgagggccagaaagaaccaccacagctcctccaggcaccagcccttgaggctgatcttccttatctttctcttgctcctcatctggtcttggcatgcgggaggggccagtgggggtcaaggcctgggcctcggtcaggttggcacccagccctaaccccttgggcctcagtgagttgacacggggcttcactactctgcagggaggaatatgggtttgttggagaggatgcaacagtcttcaacaccttatttacttcctcttcctgcccaaacccgccccacccgccccattgacattttcttttcttttctttttttttggagatggagttttgctcttgtcatccaggctggagtacaatggctcgatctcgactcaatgcaacctccacctcccaggttcaagggattctcctgcctcagcctcccgagttgctggggttacaggcgcatgccaccatgcccggctaatttttgtatttttagtagagacagggtttcaccatgttggtcaggccggtcttgaactcctgacctcaggtgatccgtcctctttggcctcccaaagtgctgagattacaggtgtgagccaccgtgtccagcccccaccaatattttcaaggttgccctttctgatctcatattaggactgtttttgacctacagaaacagcaatttcatttggttcaacctaataacatgctgcatataccatctattacataatatctacagtgagatcagaggcagatcgctgtaaccaaatatactatttctacaggggaaatcatatgaacattcacaccgagcaggagaaaccggattataaatactcaacatggttgggcatggtggctcatgcctgtaatcccagcactttgggagaccgaggttggtagatcacctaaggtcaggagttcaagaccagcctggtcaacatggggaaaccccatctctactaaaaatacaaaaattaaccaggcatgctggtgcatgcctgtaatcccagctactcaggaggctgaggcaggacaatcacttgaactcaggaggtagaggtcgcagcgagccgagattgcgccactgcatcccagcctgggtgacagacagagactccatctcaaaaaaaaaaaaaaaaaaaaaaaaaaaacgccaattcaggtcatatttggctgccaatgggttatgaaaaaatgtttggttttcagaattattgagtttgcaattgtgaagaaagggttgcaagtctgcatgacaatagcaaatgtttagtctacgctttcttggggtcagggcctactgtatgtgctttatgtatataatttcttttccttttccttttttttttttttttgagacggagtctcactgtcacccaggctggaatgcagtggtgcaatttcggctcactgcaagctccgcctcccaggttcacgccattctcctgcctcagcctcctgagtagctgggactacaggcacccgccaccatgcccggctaattttttgtatttttttttttagtagagatgggctttcaccgtgttagccaggatggtctcgatctcctgacctcgtgatccacccacctcagcctcccaaagtgctgggattatatgtgtgagccaccacacccggccctaatttcttttcttaaaattaattaatcttttgtagagatggggcctccctatgttgcccaggccagtctcaaactcctggagttaagtgatcctcctgcctcagtctccgaaagtgctgggattacaggcatgagccactacctggcctatgtgtataatttcatttaactctcacaacagacctatgaagtcagtactattacccccatttttcagatgaggaaattgatgtccctagaggcaaactttatataaatgggattctattagagtttcaaagggcaaatgggagtttaaaacagtagtggaaggggctgctgaattagttagggcgataatgtatcctccctccctgcctaggtggttctggtttggcagtgaccctggggatcttgattgcagcctgatgatctgtctgtcccctcgaccctatcccagaactcactgattgaaggtgcggccgatgccctcgccaggtttccagcccatgccccgcagcatggccagcccataggcctccacggggaccgcctcataattagcctcctctggcacctacaggttcaggtagaggaaggagggtcaggctttgcttacactgggtcttctatttgaagtgcacttgctgccccccactgggagacctgctacgcgtcttttccaatcagctcaagggtgagttttgatttcctctttccatccctcactgtactcctccatgttcagtccttcaacaaatataaagcaccttgtctatggcaagtactgttctaggtactggggatgaagctgtgaaccaaacagacaaaaacccctacccctgcagagcttctgatctagttgtggagacatactataaataaaacccagaaaacatgatatgtcaggtggtgatgtaaagaacaagaaaacagggtaagaagatgcagagggatggagagggagtgccactgggttgacatttaagcagagatcaggagatgacagcagagggagccatgaggatatgagaagaaagtgtcccaagctgaaagcatagtaacagcaaaggccctgaggccggacaaggcttggtatgtgtgaggggtatcatgaaagtcaccatgactgaaatggagagagtgagagtagacagcagagaagggtggggaagagaccaaatcaggagagctgggcaggagtcagaggaccttgagccaggtgggagccacaagagggaccagtgaggaaattactctaatagtccagatgagagatgctggtggctcagccctttgcagtggtattggtggtggtgagaagtggtcagttctgggtgtcattttgaaaaaagatgataggattgtgctggcatattgtatggggcacgaaataaagagaggaattgaggatgactccaaggttttcttttttttttttcttgagatgaagtcttgctgtgttgcccaggctggagtgcagttgcatgatctcagctcactgcaacctcagtctcctgggttcaagcgattctcctgcctcagcctcccgagtagctgtgattacaggcacgtgccaccatgcccagctaatttttgtatttttactagtgatggggtttcgccatgttggccaggctggtcttgaactcctgacctcaggtgatccgctggcctcagcctctcaaagtgttgggattacaggcgtgagccaccgcccctggctgactccaaggtttttatgctgagtgagaggaaggatggatggaatttttggtcacctgatatgtagaaagctgcaggaggaggtttatagagggaaaaattagaagaatgaggccaaagctggaacaggatgaaaggatgaagagggaagtgaggatcttttttttctttaaagatgaaggagctgggcacagtggctcacgccggtaatcccagcactttgggaggctgaggtgggtagatcacttgaggtcaggagttcaaggccagcctgaccaacgtggcgaaacctcgtctctactaaaaatacaaaaattagccaggcggtagtgacacgtgtctgtaatcccagctacttgggaggctgaggcaggagaatcgcttgatcccaggaccgggaggttgcagtgagccgagatcacaccacttcactccagcctgggcgacagggcaagactctatctcaaaaaacaaaaaacaaacaaacaaaaaaatgttgaaggaaaccagggcacatctgaaggctgaagagaacagttcagttgaaagagagagtggtgtggggctgtaggagaactagactcaaaagaagcagtgcaagaaatttatgaaagaagaggtgaaaagtcaggtctgtgggtatgaaagacagacttggttacttctgtagacatgcctctcacgtcccctcttgtcacctcccatcatcactccttcccattcactccagatacaccacatgttgcctcactgatggacacaccatatcgattttctaccactatgccattgcttgggctgttactactaacaggagtactcactctgttcttccctctctcactaaaccctacttatccttccagaccactctggtctaagtccccagcatctctagcctggactactcatccccttgcttccaccttcactaatgagtctgttcacagcttccagagggatactgtcaaatcataaatcatatttcatctatgctcagggcttgtccaggctctcatctcactcagagtaaaagccaaagtcctcacaatggcctacaaggccctgcctggtctagcacccccatctcctttctgacttcatctactaccccttccccttactcattccacttcagtcacactggtctccttggtgttccgcaaacactttaggcagtgtctaccttcagggcctttacatttcctgttccctttgctgcacacctcattcagataatcctaggattcaagtacgtttttagcatccagatacccagattcatttggtaatgcttccaaaatgatgacagaaggggcaggtggcgggcctctagcacacacacagactttccctgctacgtgcagggacacagcctggcggacagggcaaagaaaggctggggcaggagggggacaaggggccagctcactgtctctgcccggggttcgctgtctgccccttccccgctgggggtgcatcctttctggatcatggggatagcgagcgtggggtcgacacccgcattctctctctcttccagagacttcttggattctaaaggaagaataggagggagcaatgaagtcccactctatccttccaccttcttcctcttcttccttcaatggggaagggtaaaggggtatcactcacccgcaatgagctccttcacagcctgggacaccaccccatccgccaaggccccagtatctgtggatggcccagggggccgggctggtggctgcctgcgatggccattctggatcaaagggatgacgagttccttgggggcctcctggggcttcacactgatgtggacacagaggggtggggttgggagaatggcagggtcagtgggtcacactccttcattcagagaaaacacaagagccaaactcaccccagccccacagaccatgtcttccctactccatgtctggatctcctgttcctctctgatcgtgcattctctggattatctccccagtgcccccaactcataaatgtcagtgccttcgagaaataagtcctgcactctctgtttaactcaataccggcttctacaatggcccacaaatcactatcttcagcccagaccttccccagctccaggttcccaaacagcttcctagatgcctgattctcttctggaaatccctccctcagacccctcagacactcctctcctcattaagctgatggtggcctccatcaacctgaatctgccgctccatcccgttccccatatcggggacgcctcagcccttcagttgagacactagcaggtcctgtcattttctcattctttccttctcccagaacgcacagaccttagtgtcttcaagtcctagagacacttcttctcagtaatacatcctctcttcgcaattcccacagctatcaggcccaatttcctcaccccctcctataaactcccgccttctggcctccacgaatttactcaggctgtgtttcaggcttaacaggtcactgtcaccaagacaaacaactgagattcctccctcccgcttacgcccaccgcagagatttccaaggggtgaaagacccggcgcgtcacctctgcagctccctcccttccacggttttcaagaaatccttctcctccggagatggccccgcgccgtctcccgagtcggccagccgcctccgtgcggacgtgcgagtgaagccgaatgaaattggggcagtggaagcagccgtcagcggcaaaacaccctctttggagtcagccatcttgctccttttcccaggccggcgcgctgcttgctgggaaatttagtttgggttcagatcgctaggggccggccaaagtgcgtaaaaactaccttcccatcaaccactgtggcaccggcgggagggggcggtaaggggccgtgggaagtaattgtcgctctttcaaacgtggtgggagcgcgtcgcgccaagcgcccagggaaatgtagttttttttttgtttgttttgttttgttttttaagatggagtctcgctctgtttcacaggctggagtgcagtggcgtgatctcggctcactgcaacctccgcctcccaggttcaagcgattctcctgcctcagcctcccgagtagctgagactaaaggcatgcgccaccacgcctggctaatttttgtatttttagtagagacggggtttcaccgtgttagccaggatggtctcgatttcctgacctcgtgattctcctgcctcggcctcccacagtgctgggattacaggtgtgagccaccacgcctggctggaaatgtagtttttagcggggtaggcatggtggaaggtggattcattcttgccagacattaatcttccttcgtgtaggcgtttgacaagtatttatggagcgcctaatgtgtgccctacttatgtgggaagtgttgatgaagtaaatcatttagaaataatcagctgggtgtggtggcgcgcacctgtagttccatttactccgcaggctgaggcaggaggatggcctgaggcctgggaattcgaggctgcacttagctcttatcgcaccactgcattccagcctgggtgacagagcgagaccccatctctaaaaaagaaaaaggtcgggggtgggggggatggagcgtcagttgtgtacaataataaataatagacataaaataaataatagacataaaaaaccccgtctctactgaaaatacaaaaattagaggggcgtggtggctcatgcctgtaatcccagcattttgggaggccgaggctggtggatcacctgaggtcaggactttgagaccagcctgactcatatggtgaaaccctgtctctactaaaaatacaaaaattagccgggcgtggtggtggcgcctgtatccccagctacttgggaggctgagacaggaggattgcttgaatccgggagacagagtttgcagtgagccgagatcctgccactgcactccagcctgggcgacagagcgagactccgtcttaaaaaagaaaaaagaaagaaagaaagaaatagtgcctattggccaggctcatacccgtaatcccagcactttaggaggccgaggcgggcggatcacttgaggccagtagttcgagaccagcctggccaacatggtgaaaccccgtctctactgaaaatacaaaaattagcggggtgtggtggcgcatgcctgtaatcccagctactcgggaggttgaggcaggagaatcgcttgaacccgggaggcggaggttacagtgagccgagatctcaacactccggcctgggctatagagtgacactcagtctcaaaaacaaaagaaaaacaaaaaaaaaaaaaaaaaaagaaaaagaatagtgcctactgatgtcagattttaatactcaacaaggcactagattcaaatatcaataaaataggctgggcacagtggctcatgcctgtaatcccagcactttgggagacctaggcgggcggaccacctgaggtcaagagtttgagaccagcctggccaacatggcaaaacccaatctccactaaaaatacaaaaattagccgggtgtggtggcacatgcttgtaatcccagctactcgggaggtggaggcaggagaatcgcttgaacctagtaggtggaagttgcagtgagccaagattgccccactgcactccagcctgggcaacagagcgagactctgtctcaaaaaaaaaaaaaagaaaaagaaaagaaaaagaaaaaaaagaaacttgtagtctagtagggaatacagacatttaaatacatattttaaaaatatagcaacatgtgccgagcttagtggctcacgcctataatcccagcactttgggaggcctaggcaggaggattgtttgagctcaggactttgagaccaccctgggcaacctagtgacaccctgactctacaaaaaaatttaaaaattaatggggtgtggtggcgcacatctgtggacccagctactcagagggctgaggggggaggatcacttcagcccaggaggttgaggatgcactgagcggtgatcaggccacagcactacagcctgggcaacacacacacatatacatatagcaacattaaacatattgtgagaaccaggtcctaaggcttcaaagattactgatatgaaggaaaaatgaagcagtcagaaaattaaaaaaaaaaaagattattgagacagatctctcttgtgtaggacctcaagagttcatacaggcagggtgcggtggttcatgcctgtaatcccagcactctgagaagccgaggcaggtggatcacttgaggccaggagttcaagaccaacctggcaaacatggcaaaactctgtctctactaaacatacaaaaattggccgggcatggtggcaggcgcctgtggttccagctactcaggaggctgaggcatgagaatcgcttgaacccgggaggtggaggttgcagtgagccgagatcacgtcattgcactccagcttgggcgacagagtgaaactctgccttagaaaatgaaaaaaaatttaaaatgaaaaaaaaaaagagtttatacagagtggcttatacagagttgctgggtgtggtggctcacacctgtactttcagcactatgggaggctgaggcaggaggattacttgaggccaggagttggtggatacagtgagctatgatcgtggcactgcactatagcttgtgtgacagagcaagatcctgcctctaaaaaagtaaataagtaaaataaaaataaaatagtttgtacagtagatgacagatacttaaatattcttaagaaagagtaatataattctgctacaaattaggctcaaggatatcattgaagatgtgtaaaataattttttatgagattcattatcatattattgtggcaaaagcttgaagaccacttaaattatcaacagaaggggatgcagtaaatgaattacagcacacaccttggatgaaagaaatacgcctttacattggaagttgtaaataaatatatatatataaaatatatatatatatacatatatatattttttgagacagggtctcactctgttgcccaggctggagtgtagtggtgtgattttggctcactgcaacctccacctcccaggttcaagcgattctcgtgcctcagcctcctgagtagctgggattagaggtgcctgacacaacgctgggctaatttttctattttcagtagaggtgggattttgccatgttggccaggttagtctcaaactcctcacctcaggtaatccgactgccttggcctcccaaagtgctgagattacaggcgtgagtcactgcatgaccagctgctataaatataattaaatggactgggcacggtggctcatgcctataatcccagcgctttgggaggctgaggcaggcagatcctctgaggtcgggagttcgagaccagcctggccaacatggtgaaaccccatctgtactaaaaataaaaaattagccatgtgtggtagtggttaccgataatcccagttactcgggaggctgaggcaggagcatcgcttgaacccaggaggcaggggttgtggtgagctgagattgtgccactggactacagcctgggtgacagagctaaactccctctcaaataaataaataaataaataaataaaagaaaagaaaagaaaaaaatataaaattgaatgaaatggggacataccatattttggaaggtaaattagtatggtggtttggagaatggtcttaaaaagaggcaacccgttattcaatctcatggccatgtttccaggtatagaagctctgggcattctggcatgggccctggaatctcaagggtaaaaccactttgcttttcaaggtacaacaaaattcattaaaatgtatttaaaggtgaggcacggtggctcatgcctgtaatctcagcactttgggaggccaagtcaggaggatcgcttgagcccaggagttggaggctgcagtgagctccgattgcaccactgcactccagcctgggcagcaaaggcagaggttgtggtgagccgaggtcgcgccactgtactccagcctgggcgacagagcaagacttcatgtcagaaaaaaaaagactttagacttctgctttttttttgagacggagtctcgttctgtcacccagactggagtgcagtggcacaacctccgttcaccgcaacctccacctcccccaggttcaagcaattctcctgcctcagcccccccgaatagctgggactacaggcgcatgccaccaggcctggctaattttttgtatatttagtagagacagggtttcaccgtgttagccagggtggtctcgatctcctgacctcgtgatgcgcctgccttggcctcccaaagtgctgggattacaggcgtgagccactgcacccggcctggttttctttttgtttttgtttttgtttttgttttttgtttttgatttttgaaatggagtctcactctgtcacccaggctggagtgcagtggcgcgacctcggctcactgcaacttctgcctcctgggttcaagaatttctcctgccttggctgggcatggtggctcacacctgtaatcccaccactttgggaggccgaggcaggcggatcacgaggtcaggagatcaagaccatcctggctaacatggtgaaactccatctctactaaaaatacaaaaaattagccgggcgtggtggcgagcgcctgtagtcccagctactcaggaggctgaggcatgagaatggtgtgaacccgggaggtggaggttgcagtgagcggagactgcgccactgcactccagcctgggcgacagagtgagaccccgtctcattaaaaaaaaaaaaaaaagaatttctcctgccttagcttcccgagtagctgagattacaggcacccgcaaacgcccggctaatttttgtatttttagtagaggcagggtttcaccatattggccagagtggtctcgaactcctgacctcgtgatccacccgcctcggcctccccaagtgctgggattacaggtgtgagccaccgtgcccggccttttttttgttttttgagatggagtctcattctgtggcccaggctggagtgcagcagcgccgtcacggctcaccgcaaccttcacctcctgggttcaagcaattctcctacttcagcctcccaagtagctgggattacaagtgcgtgccaccacgcccagctaatttttgtatttttagtagacggggtttcaccatgttgatcaggctggtcttgaactcctgacctcaggtaatccacccactttggcctcccaaagtgctgggattacaggtgtgagccaccacgcctggtccaaaaaatacttctgaaaaatatagttcacttattttctggaacacccctcaatatagatttgtcttgtgatttctcatttattagactgagattatgagttttgggcaagaatgtcatggagatgatgtgcccttctaatcacatcatatcaaggagttcatgatgttgataagtcctattgttaattacatgaacatgaatcagttggttaaggtgttgtctaccaggtttctccactggttccattgcctgcaatgcaaactgtccgtggaggaagtgatacccacttcctaaagcagccgcctgaggcaatgtgcgcaatgcagccttatacacgctggcacaagaggtccctgaaggagttttgttttttgtttttaagcaagagttcctaggaaaacctgagagttttaccttctcagctggttcacactttgtctctgacttgctcctgatatgtatcatggagatcaccccagcctaacctgatcctgatgcatttttttttttgagacaatcttgctctgtcacctaggctggagtgcagtggcgtgatcttggctcaccgcaacctccatcttccgggttcaatcgattctcctgcctcagcctcccgagtagctgggactacagccatgcgccacctcgttctgctaatttttgtatttttagtagagatggggtttcaccatgttggccaggctggtctcgaactcctgagctcaagtgatccacccgccttggcctcccaaagtgctgggattataggcgtgagccaccacagcagaacttgatgcaaaatttttggtggtgaaaatataatggtgactcatgcctgtatcctcagctaccctggaggcaaaggtgggagtgttgcttgtacccaggagtttgagaccaggctgggcaacatagtgagatcctgtctgtaacaaaagaataaaaaagagggaggaagaaaaatatataataagagaaaagacctttgtttctgtctttacttcatactgaaaaaatcaggagtaacatttagaaaagtatttgcttaccatataattaaggaaaaccatatccaagttttacaaaaccagccatttattcttttgctcattcaataatcattaattgagtatccactctgttaacaggtcctgcctccaaggaactcatatgagatgggaaaatcagggattacaaatgtgtctaagacctcagacacagatggctgtagggaagggtggtcaaacagacaaaatggggattaattgtgcccagcactacttccaaaatggaccgaagactgaaaaaggattgtgaaggatggcaggaagtgaagttggagtgaggtgcagaggctaggtcatggatagcagggaatattaggactttgctggggtaatgaggaagtcatgagaaggttatgggacatgacaaaaatttgtgttttatttaaaagtatttaaaaaaaaaggtagaacagcctgggcaacatggcaaaaccccatctttacaaaatatacaaaaattggcctggcgcggtggctcacacctgtaatcatagcactttgggaggcctaagcgggtggatcacgaggtcaggaggtcaagaccagcctggtcaatatggtgaaaccctgtctctactaaaaatacaaaaattagccaggcgtggtggtgcacacctgtaatcccagctactcagaaagctgaggcagaagaatcgcttgaacttgggaggcggaggttgcagtgagctgagatcatgccactgcactccagcctgggtgacagagtgagactccatctcaaaaataaaataaaataaaatataaaaataaaattattagcagggcatggtggcaggcgcctgtaatcccagctactcgggaggctgagatgggaggattgcttgagcccaggaggtcaaggctgcagtgagccaagatcgtgccaccgcaccccagcctggacaacagagcaagaccctgtttcaaaaaaaccccaaaaagtaacatgcataaaacatacagggtcaacatccccaaaatgcaaagagctcctccaattcaataactatcaactgcaggaaatccctgactgaaaaataggcaatggacataatcaggtatttcataacataagatatacaggctgggaacagtggctcatgcctgtaatcccagcactttgggaggccaaggtgggcggatcacctgaggtcaggagttcgagaccagcctggccaatatggtgaaaccccatctctattttttgtaaaaatacaaaaaaattagctgggcgtggtggcgggcacctgtaatcccagctactcgggaggctgaggcaggagaatcgcttgaacgtgggaggcggaggttgcagtgagccgagatcgcgccattgcactccagcctgggcgacaagagttaaactccatcacacagacacacacacacacacacacacacacacacacacacacgaaaagaaaaaaagaaaaaaaagaaagaagtacaaatcacggccgggtgcggtggctcactcctataattccagcactttgtgaggatgaggcgggcggattaccaggtcaagagtttgagaccagcctggccaacatggtgaaaccccatctctactaaaaatacaaaaattagctgggcgtggtggcacctgcctgtaatcccaactactcaggaggctgaagcaggagaattgcttgaacctgggaggtggaggttgcagtgagctgagattacgccaccgcactccagcctggggaacaacagcaaaactccatctcaaaaaaaaaaaaaaaaaaaaaaagaattagttcactttggaagggtgaggcaagacaatcacttgaggctgggagttcgagaccagcctgggcaacttagcaagaccccccccccccacgcccatctctccaaaattaaaaaattagccttgcatggtggtgcctgcctgtagtccaagttattggggagactgagatgggaggattgcttgagcccaggagttggaggctgcagtgaactatgatgccacttactttatcgataaataagtgtcttagactgtttatgttgctataaggtaataactgagcctgatttatttatttatttatttatttatttatttatttatttatttatttttgagacagagtcttactctgtcacccaggctggagtgcagtggcacgatctcagctcactgcaacctctgcctcccgggtttaagcgattctcatgcctcagcctcccgagtagctgggactgcaggcatgtgccaccatgcccggttaatttttgtatttttagtagagacggaggtttcaccatgttggcccggctggtcttgaactcctgatctcaggtgatctgcccacctcggcctcccaaagtgctgggattacaggcgtgagccaccgtgcctggcaggtaacttatttttattttatttatttaattttattttttgagatgtactcttgctgtgtcgccaggctggagtgcagtggcatgatctcagctcactgcaacctctgcctcctgggctcaagcaattatcctgcctcagcctcccaagcagctgggactacaggcacccgccaccacgtctagctttttttttttttttttagtagagatggggtttcaccatgctgctcaggctggtcttgaactcctgagctcaggcaatccacccgcctcagcctcccaaagtgctaggattacaggcttgagccaccgcacccggccttatttttattttatttatttttttatttttgagatggagtttcgctcttgttgcccaagctggagtgccatggcatgatctcggcccactgcaacctctgcctcccaggttcaagcgattctcctgcttcagcctcccaagtagctgagattacaggcacgtgccaccacacccagcaaattttgtatttttagtagacacggggtttctccatgttgtccaggctggtctcgaactcccaacctcaggtgattggcccgcctcggcctcccaaaatgatgggattgcaggcgtgagccaccacatccagccaggtaatttacttttatttatttatttatttttgggaaaaggtatcacactgtttgcccaggctggagtacagtggctcagtcataacttactgcaatctcaaattcctgggctcaagcactcctcccacctcaggctcccaagtaattcccagctaattttttctttttttagtggaaaggaagtcgcactatgttgcccagccttgtcttgaactcctgggctcaagtgatcttcttgtgactgggtaatgtatttatttttatttataaatgttttttatttatataattgggactcactatgttgcccaggctggtctccaactcctgagctcaagcaaccctcttgccttgacctcccaaagtgttagcattacaggtgtgagccactgtgcccggcacttgaaatctttttaaacatttttatttacttattagttatttaaggctgggtaattcataaagtgaagaggtttatgtggctcacagttctgcagactgtacaagaagcatgacagtatctgtttggcttctggtcagggccttttgctgctttcattcatggcctaagtccaaggagagccaccatgcagagatcacataggaagagccatgcaagagagaggggaagtgccaggctctttctttccttctttccttccttctttctttcctttcttctttccttccttccttctttccttcttccttccttcctccttccttccttccttccttcctcccttcctctctctttgtttcttttttagatggagtctcactctgttgtcaggctgaagtgcagtggtgcaatctcatctcactgcaacctccgcctcccgggttcaagcgattctcctgtctcagcctcctgagtagctgggactacaggcacgcgccaccacgcccggctaattttttgtatttttagtagagacagcgtttcaccatgttggccagaatggtctcaatctcttgacctcgtgatccacccacctcggcctcccaaagtgctgggattacaggagtgagccaccacgcccagcctttgccaggctcttttcaacaaccagttccccagggaactaagagtgagaacgaactcactcccttcctgagagatccacccacaagatccaaacacctctaatcaggcccctcctccaacactggggatcaaattttaacacgagggttggcggagccaaaccgtgtctaaaccataggagtaagcttttctgtgttatttgtgacaattcatcaatctgtatgcttataaatcagtgtatgccataccgtgattaaacaggtttaaaaattcttctagaagttttaacagggaacaatagctagaatattttgttaagtggaaaaagcaatttcagaagtgtgcaggtgacttctggggaattggtcacagtctcttttttaacctggcaggggttacacatatattaattttacaattcattaaactgtttatgtacattgtatgcatgttcttctctattagctatatatcaccattttaaaaactagagagagaaggactttcagatgggtaggatgaggagcttagtggaccttctccccaacaaagcaagcataactggtggaaattattaaaaaataaaacaacaaccccctgagagttttcaaaggtcatacagcaaatggagacacatttattcaagaaaataggccgggtgtggtggctcacgcctgtaatcccagcactctgggaggccgaggtgggtggatcatttgaggtcaggactttgagaccagcctggccaacatgatgaaaccccgtctctactaaaaattaaaaaataattagccgggtgtggtggcacatgcttgtaatcccagctactggggaggccgaggcaggagaattgcttgaacccaggaggcagaggttgcagtgagcaaagctcacgccactgcactccagcaagggcaacaagagtgaaactgtctcaaaaataaaaataaaataaaataggccaggtgcggtggctcacacctgtaattctagcactttgggaggccgaggtgggtggatcacctgaggtcgggagttcgaaaccagactgcccaacatggtgaaaccccatttctactaaaaatacaaaaattagccgggcgtggtggtgcatgcttgtaattccagctactcgggaggctgaggcaggagtattgcttgaacctgggaggcagaggctacagtgagccgagatggtgccactgcactccagcctgggcaacagagctagactttgtctcaaaaaaacaaaacaaaacaaaacaaaacaaaaacccaaaaaacaataacaacgaccaaaaaaaaaaccttaagggaaggggaaagtatgatgacactatttcatcaaatagagaagattaagtaagaagtaaaaattacaaaaaacccacaaattgccgggcgcggtggctcacgcctgtaatcccagcaccttgggaggctgaggcgggtggatcacgaggtcaggagatcgagatcatcctggctaacacggtgaaaccctgtctctaataaaaatacaaaaacaaattagtctggtgtggtggcgggtgcctgtagtcccagctactcaggaggctgaggcaggagaatggtgtgaacctgggaggcaaagcttgcagtgagccgagatcgcgccactgcactccaggctgggcgacagagtgagactccgtctcaaaacaaaacaaaaccccacaaatcttgaagttgaatagtactgtataataactgaaatgagaagagaaaaaagaaaaaaattcactagaggggataacagtaaattagagctggcaggcaaaagcaccagtgaactagtagagagaacaatatggattatgcaaactgaagaccagacagtagaaagaatcaagaaaaatgaacacagcatcagagaaatatgggacaccattaggtgcaccaacacacaagtaacagcaatagcagcagaagtggagacatgcgagatgaaaggggaacattaagcatacatacatacatacatacatacatacatacatacatacatacataaaagaagtgaagacaggaagtatcatggctgcgagtagctggggcctgtgttgcaagcagtaaaggaatttaccaagacagtcgtaggtaaagaaaagcagatttggctcagcgtggtggctcacgcctgtaatcccagcactctgggaggccaaggcaggaggatcatgaggtcaggagattgagaccatcctggctaacacggtgaaaccccatctctactaaaaatacaaaaaaaaaaattagctgggtgtggtggtgggtgcctgtagtcccagctactcgggaggctgaggcaggggaatggcgtgaacccaggaggcagagcttgcagtgagccaagatcgggccactgcactccagcctgggcgacagagcaagactctgtctcaaaaaaaagaaaataaaagaaaagaaaaacaaatttaggccaggcacagtggctcacatctgtaatcccagcacactgggaggcctaggtgggtggatcatttgaggtcaggagtttgagaccagcctggccaccatggtgaaaccccatctctactaaaaatacaaaaattagccaggcatggtggtgcatgcctgaaataccagctacttgggaggctgagacaggtgaatcgcctgaacccaggagacggaggttgcagtgagccaagattgcgccactgtactccagccttggcaacagagggagacgccgtcccccccaaaaaaatttaaaaaaataaaaaataaaaaagtctgggcatggtggctcatgcctgtaatcccagcactttgggaggctgaggtgggaggatcacctgaggtcaggagtttgagaccagcctgaccaacatggagaaaccctgtctctatttaaaaaaatacaaaattaatcccagctacttgggaggctgaggcaggagaattgcttgaacctgggaggcagagtttgcggcgagccaacatcacgccattgtactacagcctgggcaacaacagctaaactctgtctcaaaaaaaaaaaaaaaaagaaaaaaaggaaaaaagaaaagcagatttgttagagaaagtatgaagatacattgcagggtacaacaggcagcagagaaggggctgtctgccaagaggcgggggctggaggttcatgctggaggggcctacctggtggaatgaggtcattgtgccagcaggttgtttgtgattagccatctctcagaacaattgttcattgttctccccatcctggggcccttcctgaactagggccccttccttgttacttagttatcaggactaaacaggaaggaacagaaaaaaatatccaaagaaataacagctaaaaacttcccacatttgatggagaaacttgttttttttttttttttgagatggggtctcactctgtcacccaggctggggtgcagtggctcaacacaactcactgcagcctcaacctcccagactcaagcgatcctcccacctcagcctccgaagtagatgagactacaggcacacaccaccatgcccaggtttttaaaaaaattattatttgtagagatgtggtcttgctatgcccagggtggtcttaaactcctgggctcaagggatcttccatcctaggcctctcaacctgttgggattacaggcatgagccaccatgcccagcctgatggagaaactttctttattctttttttttcagatggagtctccctctgtcaaccagactggagtgcagtggctcgatctcagctcactgcaacctccacctccctggttcaagtgattctcctgccccagcctcctgagcagctgggattacaggtgcccacaaccatgctaagctaatttttgtctttctttctttctttctttcttccctttttttttttttttttttgagacgaagtctcgctctgttgcccaagctggagtgcagtggcgtgatctcagctcactgcaaccttcacttcccgggttcaagcaattctctgcctcagcctcccgagtagctgggattacaggtgcccaccaccactcccagctagtttttgtagtttttactacagatggggtttcaccatattagccaggctggtctcaaactcctggcctcaggtgatctacccgccttggcctcccaaaatgctgggattacaggcgtgaaccactgtgcctggcctttttttttttttttttttttttgagacggagtttcactcttgttgcccaggctggagggcaatggcgcaatctcggctcactgtaacctctgcctcctgggttcaagcgattctcctgcctcagcctcctgagtagctgggattacaggcatgtaccaccatgcctggctaattttgtatttttagtaaagacagggtttcaccatgttggtcaggctgctcttgaactcctgacctgaagtgatctgcccacctaagcctcccaaagtactaggactataggcatgagtcaccacgtgggtccctgatggagaaattttaatctacacatccaagaagttcaatgaacaagtaagataaatgcaaagaggtccacacctagtgtaggatccctgagttcctcctcctttctttttgtgttctgacctaaaatcacagagtgctttggccattcttccacccagcgagctgcaggtttttctcagcaggcttgaacccaaaccaaggccttgaacattcccaggcactgataaaggtatctgggttgttgcccaagcactgaaagaaactgaccctagccctgaacaaattccttaaagcctcatataaactccataccgtgaccctttggctgtggacatacctaagtagaacaccccttttctctcattgtccctcataaggacagagtgctgtctctaggaatcgatggaactggactggatccctgagtaaatattttagtccaaggggaggtccacaagcgatctgtctctgcagcactctgtatgtaaattcccccaatatgcattttgggcttatcgccctggcatttagtgcttctgtttttggaatcccaactcatcccatctcaggatcattttgtagcaggacgagccgcagacagaacccctcagacactgggttaaagaaggaagaggctttattcggccaggagcatcggcaggcttgcgtctcaagaactgagtcccagagaaagagttcttggcccttttaagggcttacagctctaaggggtccacatgaaagggtcgtgatagattgaacaagcatggggtacatggctaggtgggggtggtgagcaaggcaagtgtttctccataccattgtctgtgatctatagacagcacaagcggttagggtgtgggttaatctttaacctacgggcctggccagtggtgctgatcagtctgttattttttcagtttttacttcctccttttctttggagataggggacagtaggagaaatggcctctctcctcattcccccctttgagaacctcactcactagtgggagttctcattatcatcctcactatctagatcttcctgtgagacagatcaatagtgattcatgtagtatacttgtgctgaggtcttttgatgaactaaggtgataacgaagcttcttagtaactggagaaatatgggtaacatacaggggagtaacatgcaggttcctaacaccattatcattcctattataagagttttaaatcctcctagagctggaagccattttccaaacagggatccaggatcaaacctatgccaaacctgcatgggtacatgtgccagctttgtcatgtctctaactatatttttgactacttgtccttgatcatctctttgcagacagcacttggtcaagttgaatttttcacagactcctccttcagctgccagcaaatagtctaaggccaatctattctgatagatggcatttctcatttgggtttcctgctgggctaaaagagttaaagctctgccagtttcactagtgattatttctaagatggcctgtaaccgtatgatccagttgagcatgtagatgggggtatggtatccctatgagtcgtcttgtgcccatgtggcaggcctatagtactgtatgatcctttcggggcaccactcatcatctttccaatttgctatagctatgctcctcttttcttgggaggcatagacagggaaacctaggaggtcacctgtttttatgggcagtaggaaaaaggatggcttaatggtgccaatgacacaactacctgcccattgatcaggtaactgagtgtaggctctgtgcctacatatccagtatagtccagcgggagccatccagtcttgatgagattgtggatgggcctaagcagtctgtaatttaggaaatttactgaagggattattttcagtatggtttagaccccaccaggtgactgtccctgtgtccctgttatgcttttatacagcttctgtcctagacaattgagccttcctacagggatggtgaagtcttttccttttctaggtatgcagtattgtccattaatagaggttttcaagacccaaaagttgctagtttgggccttctggactggaattatgtcaggaactggatcagtaggcactaattcttgggtttcccaaggccatcagtctcccatagtggttccctcacatacataacaggaagtaacattgagggaatgagctacatattctgctaactggagaaacaagttctttgtccttttttgtggaagctctggtgctggcagattcagctcatcataaaaggtctgaaacactggtttggaagatcgcttgtggacctccccttggactaaaatatttactcagggatccagtccagttccatcgattcctagagttacatactctcctgttttccagcagggatcaaggggattggtaattagtagttcaatgggttacagtgaccactagtgcaggaagagttactctttcctttttgaaggcggacagggtccttctcatctttttttccaggtggcctaaatgacacaggaccagtaactacattcatcacttcacagtcctaattcatgacaaacatacttattttctactatatagcccctttcccaatctagagagccacatcttattctatttccatatgggtcactgttgattgctgcacaggcatcaaattttaagataatttgtttggggactcctttctcttctgttctagttattactttactagtatcagcttttccccagctgccagtcctcgatcttatttcaaaaacagtagtcataggggggctcagatgggttatagtacacatcagactggtcacttcctgggctacataccttgtatagagtagcattatacaaacaagttccttttagagtcccagtacactcatactaactataaaataataggactgcagcaaccttttgtcctaccttagtgacttgattttgtcctaccttagtgactgggaacagttctcagtctgaggaaggtcagctgaagtccttactgtacaagtccaaaatttaaggaaaatgagtcccacgatgagttttctcatgctttggccatgcgtggaccagtcagcttctgagtgtgactggagcagggcttgtcatcttcttcagagtcactttgcaggggttatctaggcttggtctcacctcccaggtctcaggtgctgcaggttttacctggctgtgttggatccaggctgggattccctctatctttacggctgtgggagtggtcaagatgatggtctggggtcctttccaccgtggccgcaaggagcctatgttccaatccttgatccacacctgatcacctggggagaaagggtgaactggggagaataagctgccggggcacctctcatttacccaggctgaaattgtgtaattttccctaaagcctgtagctgtcgctgtaacgcaatttcacctagctctcgaggagtgcctgggagtccccgtagtatgggagggggcctatgatataatatttcataaggggaatatcctgttcttctagaaggggtacatctaatcttaaataataccatagggagagcttgtacccactttaatcctgtttcttgacacactttccctaaactatttccgatagtgcgattcatctgcttcacctttccggaactttgtggtcagtaggtggtatgtagtttccatgtgatccccaatacctttgctgtcttctgtaacaagtcagccacaaatgccggcccgttgtctgagctgatttgtaagggcagtccaaacctagggatgagatctcggagaagcacatgggttacttcacgagctttctcggtccgtgttggataggcctccacccacccagagtatgtacacactagaactagcaaatacttgttacctccacatttgggcatcttggtgaagtctacttggagatcttcaaaaggggctgctccataagcttgtatgctggcggggatggttagaccttgcctagcattgtgctgccagaaggtgacacactgctgcgccactgttttggcaagggctgaaagatgcaagatgtagaagtaccagcctaacaacttttcaagtgactcttggcctaggtgggtggtctcatgcacagccagtatgactgcggctcctagcagttgtggcacagctattcttccatccgataactggatccatccctcttctatcacctgccctccctctgcctggagaaagtccttctctttagaataagtaggtacaaggtcaggtgcctgagggagcagggggctgtgactgatgcctggtagggggtggatgctgcttttcgagcctctgagtcagcttgggggttccccaaggcaatcgaggtagaagctcgctggtgtcctctgcagtgcatgagccaccttttggggcttccacactgcctctaataattgcaggatctcttgctgatactttatgtcttttctcccagcgttcaacagggctttttccttgtagaatgccccacgcagttggagagttaaaaaggcataccaagagtcagtgtaaatgtttacagtcttaccttcacttagctcaaaggccagaattaaagcaatgagtttggtcttgcgggctgaagtgccctggggcaacgatttggcttcaatgacagcatccaggattaccatatcctacacacctctcttcttgtgggtcgacaaagctgctcccgtccacgtacagctcccagtctactgttgtccaaggatggtctcggaggtcgggcctgctagaataaactgactgcaacacctctacacagttatgttcaacttggctctctgataccaggagcaaggtggcggggttcagggtgttgcaaacttcaatggttatgcggggattctcacagagcaagctttggtacctagttagtctagcattcgttagccagttacgtcctttggtgttcattagtgttaccacagcatggggaggcctttatgttttttcttttttttgagatggagtctcactctgttgcccaggctggagtgcagtggtgcgatcttggctcactgcaagctctgcctcccgggatcacgccattctcctgcctcagcctcccgagtagctgggactacaggcgcccgccaccatgcccggctaatttttctgtatttttagtagagatggggtttcaccgtgttagccaggatgatctcgatctcctgacctcatgacccgcccgcctcagcctcccaaagtgctggtattacaagcgtgaaccaccgtgcccagctagggggcctttatgtttaggttttgccctaaacataaagttagggcaagaggtagcttatctgcctctagtgctagcagggcagttgctgccaaggctcttaagcacaggggccaggctcaattatcgacagataattcttgtcgatactggtgctgaacattcagtagtaaccaccccagtcgcccccttatccaaaaagactattgatataattggagccacgggggtttcggcaaagcaagctttctgtttgccccagacctgcactgtcagggggcatgagataattcaccagcaattcatcctgcctggactttctccaggcagagggagggcaggtgatagaagagggatggatccagttgtcggatggaagaatagccatgccacaactgctaggagccgcagtcatactggctgtgcatgagaccacccacctaggccaagagtcacttgaaaagttgttaggctggtacttctacatctcgcatctttcagaccttgccttagaaactccatctagctctttggagaggtaggctaccggtcttggccagggccccaccatctggattaaaactccaatggccattttttctctctctgacacatacagtgtgaaaggttttgttaggtcaggtagccccagggctggggccgacatgagtttctcttttaactcatgaaaagctcattgctgttgggacccccatttgaaaagttctgtgtctcctcactttgtgactccgtacaggggcttagccaatactgcaaagtttgggatccacaatctgcagaaccctacagctcctaagaattctctcacctgccttctggtcttaggctccagcaggttgcagatgacttgctttctttctgatcccaggctgtgctctccctgtcggatagtaaatcccaggtaacatacctgctatctgcagatctgagcttccttcttggacaccttatacctatagtcctccaggtgccagagcagggtatccattcccttggcacacatgactgccatggggtgtcccagcaggaagttgtcaacgtactggagcagcacgaagcctaggtctctggtgggaattttctggaggtctcgagccagtgcctccctgaagatggtgggggagttcttgaacccttgggggagccgggtccaagtgtactgagtggtgacagctgactccagatcctcccactgaaaggcaaacagtttttggctctcaggagatagtctgatgctaaagaaagcattttttaggtccaagcaggtgaaccagctgtcctcagctggcagcaaccccaacaatgtgtatgggttggatgcaaagtcactttgcttggttgaccatatgcaaatcctgtactggcctgtagtccttggtcctcagcttgggaacaggtaggaggggagtgttccatggagactgacaaaggactataattccaaaggccctcagatgcttgagatggacccggatgccctcaagggcttctctggggaccaggtactgcttttgcctgaccagctgggccccaggcttaacttctattagtatgggggcctggttgattgccaaccctggcgggttgtcttcctcccacacccttggccaccgcttagccagagctggtcctatctcttggcctggctcagctaagaagagtctccattcctcctcccgaggaaccataagggccatgatgactccctttccaggtaactttagctgtaaagagccatgctttgtaaaagagatagtggctctcagcttgctaagtaggtcccttcccagtaaaggcaaggggcagtcaggcatgtacaggaactggtgaattacctcatgtcccccgacagtgcaggtccagggcaaacagaaagcttgctttgccgaaacccccgtggttctgattatatcaatagtctttttggataagggggcgaccagggtggttactactggatgttcagcaccagtatcgacaagaaactcaatgtccttgcccccgactgtcattctgaccatgggctctttgggtgcacatgagcctagtccccctcagtccagtaacccttctgccagattaaacaaggccctttcgtccttgtctgaggcctcctgctcagtcaccttgtttccctttcaactgggggcacttgtccttccaacatcccatttccttacagtaagcacactggttacgctgcaagcgtggatggccggactgggtatttttcctggggcccccctttctcgccccttcgggggggacccctctattgctgtggctagcaggtcggcgtttcgctgggcttggcgttcgctctctctgcagttctctctgcggcttacagcatctctattcacaaacacctggttggctatctccaataactgtgaagtgttcatgcctgcaaacccagcctgcttatgtagttttcttctaatgtcttctgcactttgactaactaaagccatgttaatcatgcgctggttttcagggttgttgggatcaaagggagtatacatacaataggcctcacatagtctctcgtaaaattgtgctggactctcttcctttccttgaataacctcagatattttatttatattggtggccttctgagctcctttctttaacccttccaggagggcttccctctaccagtttagcctttgcataccctgtctttcatttgggtcccactgggggtctgttcctggtaactgggccatcacatactcttgggggtttttgtaatcagccggaacatgttcctctagccacttagtcgctgcttggagcacccttcgccgttcatccgtgttaaacaggcacatgagcaactggtggcaatcagcccaagtagggttgtgggtctggataatagtttggagcaaatcaattatagcctgaggcttttcagtataggatggggtattgtttttccaattgaggagattggcagaggtggagggttggtacacaaaggcacgcctttccaccatatgcccgtcctcgtttaccccagtataccgttgctctctcaggggcatttgtatcccagttttaggcctcaaatgggctaccaagtgaggagtttctcctgaggtcttgcatcctttcttttctactctaggtggcctaggggtatgtaggccttgtggaagcttgggcacagtggcctcaggagtgggaggccttctttcttggtgaaaggaggggccactggcactgtttcttgccatgaatcctttgatgttgggtcggacaggactttaggcgccgacttccctcagtgggtgaagcgggattcttccttggctgtctgtccctttgccactagtactgctgctgcctgtcctcttaaccactgtagggggtctaaaaccagctgtaaccaagtgtctatgtatggaaagtggtctgggttttctggcttaccagttaccttgtgccatacctttgaaacaaaggacctgtctaggcctccttctgatggccaacccacttctaatgctggctaatctatctcacttaggtcctaagttttcctggggtcatagtaaccccataatctccattaaaaccttttttgaaattctttaacatagttcctaatggagtggtcttactttgcgtctcacccatctccacccccacccaagacaaaaatggcactcacgacacaagaagggaaagggtaaaggggtcacccactctcctcggcagtcactggccgcttccctcgcgggaatctcagatactcttagcttaagcaggctggtaccaggcgccagcacgaactgccacttagccatgtgaggtatcctacggaactgcagcttggggctcaacgctcactttggatggcgaccactgtccatcctgtgcccgtctaaaacaagcattcactcactttcactttcctttttttcaaacaagccaagccaaatcataatcaaaactgagaccaaagtgccgataagggcacactgtgggtgatcaggccacgcttccactcaaatggagtgggtaagttcccaggactggtcctaccatattccagatgtccagactccaagtgccagttccttcctggtgttcagccgctgcattgatcctctgtgggggcctgccatgcaccgctctgacgaggtgttccacgagggcaaatgcctacccgggagtgctctcaggatccgcgttgctcaaactggccggagtcccctgcagggatgctccgcagggcaggcctaagccgcctaaggggctgcctcgaccatcgttaatcacctcgcttcccggtcagggaaccaagaaatgtaaggaagaggctttatttggtcaggagcgttggcagacatgcgtctcaagaacgaagcccccctaagaaagagttcctggcccttttaagggcttacaactctaaggggtccacgtgaaagggtcgtgatagattgaacaagcatggggtacatgactaggtgggggtggtgagcaaggcaagtgtttctccataccattgtctgtgatatatagatatcacaagcggttaggttgtgggttaatctttaacctacaggcctggccagtggtgccgatcagtctgttatttttcagtttttacttcctccttttctttggagacaggggacagtaggagaaatggcctctctcctcaatttcagccactcccttgtgggaactcccttactgctcatttttgagagattccagccatggttagacaggacaaaacactcaggcacatcatggtcaaaaatcttgaaatccaaagagaatatcttgcaagcacaaatagaaaaatgacctgtcacctataaggaaactccaataagattaagagttgacttctcatcagaaacaagagagcccagaagacagctaaaatcatatttaatggtgaaagactgaataccttccacctaagatcaggaacaaaacaagagcgtctgctcttgctccttctattcaatatcatattagaagttctagccacggcaattaggcaagaaaaaataggcattcagggccgggtgcagtagcttacgcctgtaatcccagcactttgggaggccgaagcaggtggatcacgaggtccggagtttgagaccagcctgaccaacatggtgaaaccctgtctctaccaaaaatacaaaaattagccaggcatggtggtgcgcgcctgtaatcccaactactcaggaggctgacacaggagaattgcttgaacctaggaggcggaggttgcagtgagctgagatcgcgccattgcactccagcctgggcaatagagcaagactccatctccaaaaaaaaaggctgggcgcggtggctcatgcctgtaatcccagcacttcaggaggccgaggcaggcagatcacaaggtcaggagattgagactatcctggctaacacagtgaaaccccatctctactaaaaatacaaaaaattagccaggtgtggtggcgggtggctgtagacccagctactcgggaggctgaggcaggagaatggcatgaacccgggaggcagagcttgcagtgagccgagattgcaccactgcactccaacctggcgacaaataaataattttttaaaagttagctcaaaattggctgggtgcggtggctcacgcctgtaaccccagcactttgggaggctgaggtgggcagatcatctgaggtcaggagttcaagaccagcctggccaacatggtgaagccccatctctgctacaaatacaaaaattagctggtgtggtggcgcatgcctgtgatcccagctactcaggaggctgacgcagggggaattccttgaacccagggaggggaggttgcagtgagctgagatcgtgccactgtactccagcctgggtgacagagcaagactctgtctcatatatatatatatatacatatatacacacacacaatgtatttatatatatatatgtatatacacatgcacaaatggccaataagcacaatgaaaagatgcttaaaatctgtattaatttctgattgctgctctaacaaattaccatacatttactggcttgaaacaacaccacaaaatgtcttacagttctgtagggcagaattctcatcaggctaatatcaaggtgtcagcagggctgccttccttgtggagaatctgttttccttgcctttttaagcttctacaggtggcctgcattccttggtatgtggccatttcctccatctttttctttttcttttctttttttttttttttgaggcggagtctcgctctgtcacccaggctggagtgcaatggcgtgatctcggctcactgcaagctccgcctcccaggttcacgccattctcctgcctcagcctcccaaatagctgggactacaggcgcctgccaccacgcccggctaattttttgtatttttaatagagacggggtttcactgtggtctcgatctcctgacctcgtgatctgcccgcctcggcctcccaaagtgctgtgcttacaggcgtgagccaccgcgcccggccactttttcttcttttttttttcttgagatggagtttcgcttttgttgcccatgctggagtgcaatggcgagatctctgctcactgcaacctctgcctcctgggttcaagcaattctcctgcctcaccttcccgagtagttgggattacaggcgtgtgccaccgcccggctaatttttgtatttttagtagagacggggtttcaccatgttggccaggctggtctcaaactcttgacctcaggtggtccgcccgctagccactgtgcccggctagcacttcctccatcttcaaatctttctctatcacccctgcttcacatttccttttcatcccttgtcatattttcttcactgattctcctgcatcctcttttatttttaagaactcctttgactatattgcccccctcaataatccaggataatctccccatttcaagatccttaatcacatctgcaatgtatcttttgccatataaggtaacatattcacaggttctagggattaggaggtgaacatctttgggagcttattgttctgcctatcaaaacatttatctaaagcatataaaaacataattatttattaggaaaatgcaaatcaaccataatgagatccaacctcacatccactaggatgttatattaaaaaatacagacaaggggccaggcacggtggctcacacttgtaatcccagcactttgggaggctgaggtgggtaatcccttgaggtcaggagtttgagaccagcctggccaaaatggcaaaaccccatctctactaaaaatacaaaaattagctgggtgtggtggcactcacctgtagtcccaggtacttgggaggctgaggtgggagaatcgcttggacccgggaggcagaggttgcattaaggtgagatcacaccactgcactccagtctgggccggagcaagactccatgtcaaaaaaataaatacataaaatacagataaggcagagagtggtggctcatgcctgtaattccagcactttgcgaggctgaggtgggtggatcatttgaggccaggagatctagactagcctggccaacatggcaaaaccctgtctttactaaaaatacaataaaaaaatagccaggtgtggggatgcacacctgtaatcccagctactgaggagactgaggtgcaagaatcacttgaacccgggaggtggaggttttttttgcagtgagccgagatggtgccacttcactccagcctgggcaacagatcgagaccctctctcaaaaaaatgtatagacaataacaagtgttagagacgacttggagaaattgggaacctcatacattgctggtgggattgtaaaatgttgcagtgactttggaatatagtttaatagctcctcagaatgttaaacttacccaacaattctacccctagttatatactcaagataaatgaaaacatatgtccactcaaaaattcatacacaaatgttcagggcagcattatttataatagccaaaaagtggaaacaatccaaatgttcatttaccaatgaatgtataaataaaatatggtatgcccatacaagaaatattaattagcagtataaaggagtgaggtactggcacaggctacaacatagaacttcaaaaacattgtgccttgggaaggaaatcacaaaagaccacatattgtatgattcaatatttaggaaatgagaataagcatatccgtagagatagtgtgttaatggttgccaagggctggagaagtagagctaaaggttgtggggcagactctgtgaccgtgcctgcggtctcaactactcgggagtctgaggcaggtggctcacttgagtccaggagttcgggctgtagtgtgctatgctgattgggtgttcacactaactttgtcatcaatatggtgacctctcaggactgggcaccaccagattgcctaaggaggggtgaatctacccacgctggaaacagcaggtcaaaactcctgtgcttctcagtagtggtatcgcaactgtgaatagccactgcactccagcctgggcaacatagcaagatcccatctctctaaaaaaaggctatagggtttatttatttattcattcattcattcattcattcattgagacagggtcttgctctgttgcctagcctggagtgcagtggtgtgatcaggactcactgtaacatccacctctcctgctcaagtgattcttctgcctcaacccctgaagtacctagactacaggcatttgccatcatgtcaggctacatttttattttttttttttgattgatttattttttgagatggagtcttgctctgtcaccaggctggagtgcagtggcacgatcacggctcactgcaacctctgcctcttggattcaagcgattcttgtggctcaacctcccgagtagctgggattacaggcacgcgccactgcacccaactaatttatgtatttttagtagagatggggttttaccatgttggccaggatggtctcgatctcctggccttgtgatccgcccaccttggcctcccaaagtgctgggattaaaggcgtgagccaccatgcccaacctttattttttacttttaggagagacagggtctcactatgttgcccaggctggtctggaactcctgggctcaagtgatcctcctgcttcagcctcccaaagtgttggtattacagacatgagccactgcgactggcatggggtttcttttaggaagacaaaaatgttctaaatttacaatgggatgatgattgcacaatcttgtgaatatactaaaaccaagtgtacaccttaaatgggtgaattgtatggtatgtaaattatatatatatctcaatgtctattaaaaagttattaaaagattgcaataattttctacccatgatctcctgtatttcaaacaaaaagtctgaaagttgattcagaaaaatacaggttacatggttttggttttttgttgttgttctgattcttaacatgaatatatgtattttgtttacattcgagtagctaagtttttctttctttctcttttctgttagttttgtttgtttgtttgtttatttgtttttgagatggagtctggctctgttgcccaggctggagtgcagtggcgcaatctcggctccccacaagctccacctcccaggttcatgccattctcctgcctcagcctcccaagtagctgggactacaggtgcccgccaccatgtccagctaattttttttgtatttttagtagagacggggtttcaccatgttagccaggatcgtctcgatctcctgacctcgtgatctgcccaccttggcctcccaaagtgctgggattacaggcgtgagccaccgtgcctggtctagtattttttttttttaatttttagtttcaggggtggcccagagcagtggctcatgcctgtaatcccagcactttgggaggccgaggtgggtggatcacttgggcccaggagttcaagaccagactggacaaaatggtgaaaccccatctccactaaaaatacaaacattagctgggcgtggtggcgggcacctgtaatcccagctactcagaaggctgaggcaggaggcagaggtttcaatgagccgagatggcgccattgcacttcagcctgggcaacagagcgagactctgtctcaaaaaaaaaaaaaaagttaaggggtacatgtgcaggtttgttacatagataaacgtgtgtgatgggggtttgttgtacagattatttcatcccccaggtattaagtctggtaaccattagttatttttcctgatcctctccctcctcccatcctccaatctccaataggccccagtgtgtattgttcctctctatgtgttcatgtgttctcatcatttagctcccacttatactgagaacatgcagtacttggttttctgttcctgcgttagtttgtaaaggataatggtctccaactccatccatgtccctgcaaaggacatgatctcattcttttgtatggctgcagctaagcttttcacaaagagcttaaataacatactgaaggtgaggaagcaggtaaaagcagtcagacttgaacccaggctgcctagcaccagagtttggagtcttacccaattctccatattggctcagggcttgtgctatgttttcagcctagctttgtccactgcccttcttcaccttccatccttccccatacccttgtaagcctcccgcccccaaggttcattaaggcagactccagagccacgtactgttcacagctccagaaaagtacccaaggtttttcacgcctggctgtatttgtcatgatagaacctctgcatgaaaggcaagggggtctgtggggcagacgactatccatgacattattgtccttacagcccagaacgataaaggctaggggattgaagaggcggagaaagcggttagagactctccatagaaattgtctcagccccgccccttaaattcactttctagccgcagctccttgaatttacgtccgagccacgcctccaattaaactgtctccccaccctcatctcaagtaatccccaaagctccacctccttaaagaatcttgggcccggccatttgaacacctccagaccttatcttcctatctccctttaataaagcgcagaaaacatttctcaaataacacctttaggattatctccaaatatggtcacacacacaggcaaactccattcggcccaccctggagaatgctacttcaaaatttggctcctgtggggaacatcgcacaccggggcctgtcgtggggtggagggatgggggagggatagcattaggagatatacctaatgtaaatgatgagttaatggatgcaacacaccaacatggcacatgtatacatatgtaacaaacctgcacgttgtgcacatgtaccctggaacttaaagtataataatgataataaaaaaaatttgactcccgaaccttccagagcacaccctttaatcagcctctaaccgtcatcccattcctgacatcgcaagccccgcccccatgggcctataggctccatccccatgactcacatttcaggcctgccccttcgctgcgtgctcgcccccagcactctccaggcctcaagccctcggaaaggaccctcaaggccccgccgaccagaacggggatccagctacgcacactcaactaatctggccctcacctactgcgataaccctcaaggaatattctaggataaccccaaggatccttcgaagcatcctccgaagcatcctccgatccccgccctcccaaatcgcgccccttggccccacccaaggcagggcagtagctgctgaccccccaggcctgctcctctgaacccagctcctctccgaacctgccccctgggaggccccacccccgtcacacaccctccttccggcgcaggcgcaatgtggcgcccgccctgtgtactagcgccgccacatcgaccgcagccctcgcagccagggggcgcgcgtccagccgcgccaggagcggaagggcgctggggcacgcgggcgggaggggcccaggcctgcgcgcaagaggggacaggtcaacgccgaccatcggcctccgccaacccccatgcttccggacgctcaaagactagaaatgcccctcaggatacccggcgacccctggccactccctcggtagtttcggaggtcactgctgtccctcccctctcatgcgatccccgaccatcgcgggtagcgggtgcacccccagcctgctctcacggtgtccctggagatcgctgtttgactgcaatagtcctagacacctccgaacaccccgtgaggtcctcgactgccccctaatcaccctggatgcccaactcttcatccacgatatctcaggggaccccatttcccccagatatcccgggagaacacggcctgaccccgtagccccggaacccccaattccccctctaggtatcctaggcaaccgctgctacccccatgaattccctcagagggcccgttccccccatggcccacatacctccagagtccccctccacaggtccccaggggcccccagctcccctccccccagttcactaagaccctgagtgcccaggtgtccccagtgaccacgggcagacccctccccgcacatctgcacgtctccctggagactcctgagagcccctcccctgctctggtgcgcggccctttccctcgtgtgtgggtgtgggtaggggacctccagcccagcctccatcgctgggcccctgccccctgccaccttcacttgggcgccagagccgctctgtttaccacctgtcagaaggaaaaggtgtggagcagacaggcgggacggggatggcggcgactcgccctgtccttccccaacgaccccaatccctgtacctcctctgctccccctagggtccgcggcgtcccctgtgcgcggctccatggccagtagtccgccgggtggacgcagggcagccagctacgaattttgagctctggggcgcgctcacctggcggcccgcccaggccctggaggctgaagctggcgggtcccgtgcctggctcccggacccgcgcggtgacctacctggcggccagcaaggaggcctggctgtaggagccaggaggagtgcttggcctcactctgctgcaggcgccgcactctgttaactaaaggtcctagttagaatttaaaagcctgacaataccaactgttgctgaagatatggaggaaatggaactcctataccgccggtggaaatgtaaaatgatattgcaactttatttatttatttagagacagggtttcgctcttgttgcccaggctgaagtgcaatggcacgatctcggctcactgcaacctctgcctcccgggttcaagtgattctcctgactcagcctcctgagtagctgggattacaggcatgcaccaccacgcccccctaattttgtatttttagtagagacggggtttctccatgttggtcaggctggtctcgaactccctaaagtgctgggattacaggcgaggcccgcctcagcctcccaaagtgctgggattacaggcgtgagccactcgtgcccggcctgcaactttagaaaacagtttggtagtgtctttaaaaactaagcgtacacatatgagccagccattccactcctgcgtatttatctaaaagaaagcatacatttacacagccttgtcttacaaatattcatagcagctttatttcctgtcttattcatttagaactactgtaacaaaatatcgtagactgggtggtttaaacaacataagtttctcacagttctggaagccggaaagtccacgatcaaggtggtagccaatttggttcctggtgaggtctctccttttgggttgcagatgcttgccttcttgctgtgtcctcacatggaattaagagagtgaaggagagtaaaggcgtgagagaggcacacacagagagagggagagatctctctcttctgtttcttataaggtcacagtcctatctggttagggctccaccttagtgacctcattttaccttagttgcctcctaaagaagctatcttcagatacagtcacattggaggttagagctttaacatatatatttatggctgggcacagtggctcacgcctgtaatcccagcaccttgggaggccaaggcgggtggatcacctgagttcaggagttcaagaccagcctggcgaacatggtgaaaccccatctctactaaaatatacaaaaattagccaggcgtggtgtcaggtgacttaatcccagctacttgggaggcagaggcaggagaatcatttgagcccgggaggcagaggttgcagtgagtggagatcgagccattgcactcaaacctgggggataagagcgagacttctctcaaaaaaacaaaacaacaacaacaacaacaacaaatatatatatatatatatatttatgggtggacacaattcagtccataatatttgttaatatccaaaaactggaaataacccaaatgtccattaatagttgaatgaggccagtaatcgcagcactttgggaggctgaggtgggaggatcgcttgagctcaggagttggtgaccagccttggcaacatagtgaaagattgtctctattttaaaaacatagaaacattgtctctattttaaaaatgctaatgcctgtaatcctagcactttgggaggctggaggtggaggcaggaggattgcttgagcccaggagtttgagaccagcctgggcaacatagtgagaccccatctctcaaaaagaaaacaattttcaatgaaaaaaatagatgaataaattaacaaactatggtatacacatacagggtaatacaactcagcaataaaaaacaatgaaggatttggatgaatctcaaaaataattatggtaaaacaagccagacccacgctccaaaaaagcacatgctgtatgatttcttttatataaaaatctaataaaatgcaaactgatatacagtgacagaaagtggattagtggttgcctggagggagggggccaaaagggcaggaaagaggaaatacaaagggcaggagaaaacttttggcagagatagttatactcagtatttcttttttttttttttaagtgacagggtcacattctgtcatgcaggatggattgcagtggcacaatcatagttcattgtaacctcaaactcctgggctcaagggatcctcctgagcagataggactacacatatgtgccacaatgcctggcaaattttttacatttttgtagaagactggggtgggggggtctcactatgttgtccaggctggtcttaaactcctggcttcaaaaaatcctcccacctctgcctcccaatgtgctgggattacagaggtgagccaccacacccagcctgttcagtatcttcactgtagtgatcgtttcactgacataaacatattcaaaacctatcaaattgaagtcaattatatctcaaccccttcaaaacttaaaacagctgggtgtagtgcatgcacctgtagtcccagctacttgggaggctgaggcacgaggatcacttaagcccaagacttagaggttacaatgagctgtgatcatgccactgcactccaccctcagtgacagagcaagaccctgtctttaaaaaaaataaaatataaattctcaaaacaggctgggcatgatgactcacgcctgtaattccagcactttgggaggccaaggtgagaagatcactaaggccagaattttcagaccagcctagccaatgtagcaagactttgtctctaataaataaataaatacaatcttttgttaaattaatgaattgggtggggctgtgagagaaattgacttaattcttgaattacatgaggctaaaaggggtaattagggtttttttaaatgatttttttttttttttgagacggagtttcgctctgtcacccaggctggagtgcagtagtgcgagctcggctcactacaacctccatctcctgggttcaagcaattctcatgcttcagcctcccaagtagctgagactaaaggcacccaccaccacgcccggctaatttctgcagttttagtagagacaagttttcatcatgttggccaggctggtctcaaactccgcccatctctgcctcccaaggtgctgggattacaggcatgacccaccgtgcccagctgggtaattgggttgtattcacaaatggatgaggctaagaggggcattgatttgaatccacagtggggcagggctaagtgagggtttgctcccccatagtgtcattgtaatcaatattaaagataagcaccaacactgctaccaaatagcttggcttggcacaacaccagcaatttggaagctttgttccgaactctcttgacagtcttaccatgcatatctcatcacccccacttcccagagaggtacattgaggtgtcaggcaatgcagtggctggagttcctccctcatgtctgcatcctctctacacccctaaccctgccagcagcctcagtgacacatacactactctctggccctggaatttcggccctgctggtgtcagctctctcagtgaacacctatcctgggcccctgcccctgtaatttcagccctgctggtgtcagctgtctcagtgaacacctatccagcatcctgggcccccgcccctgtaattcacgtcccctgaggatgtccttggaccccttcattcgttcatgattccccaagcctgaatacctcccagcctggaagcagtttcccatccagttggcaagctccctgatcgatgttagtagattctacctggtgcttggatgcctcccctcactgtccatctgtcctcggcccttggacaatgccccagtctgcaagaccctcccatgcatggagctacagagcctcaagctctccttcacagtgtgtaagcacctcactctcacatccacaggttcttaaaacctggagccccagattggaagctgccctctccagattcaggtgtggaagtctcaacaagaattgggaggagcagtgaaggaggtccagggtgtccccccttagacaaggtcaggtcagaggtgaaagaggcaggggactgcaggtggaatgaaagcaggaaccgttcagaccctttcacctatgaggatactgggtctctgaaaggtgaacggagaggcttgcacaaccagccagaatggacattaggacacagtgtgtccacagccatagtgaaatagtcactaaccaagtgagtcttgtaggtaagctgcctgaaactggtgttgttggcttgctgcagggacctaggcaggtccctgagcctctcagaccctgagtttcttatttggcaaagtagtggtgaaaggccctctctcactgcaatcccattcctccttccactacagtcacactgtgtccgaatgctccctgcttggggcttatgtccccagacactccccttttcaaacatagaagaggcctcattcctccactgacatcagctagtgtcccatccaactccaatgcattcattcacagcctcctcaattttgggtcccatctctcatccactctccaagggacctgccctctgcaatttttttttcttttcttttctttttctttttctttttttttttttttcttgagagggagtcttgctctgtcacccaagttggagtgcagtggaacgatctcagctcgctgcaacctccgcctcccaggttcaagcgattctcttgcctcagccccccgagtagctaagattacagatgcccactaccacacctggctaatttttataatcttagtagaaatggagttttgccatgttggccaggctggtctcaaactcctggcctcaagtgatccacctgccttggccttccaaagtgttgggattacaggcatgagccaccgcgcccagcccaccctctccaatttttgagttccgcaacctcataatgcccagagcaccaaaccattctttggctccaaaagctccaacggtactcagtcccaccacacatttccagtttcccaatagggacagtgggagataaactttccctgcaaatatactgagtgcctacttgtgcaaagctctggtggagattgcagagtttcctagtaaactcgggctccagttctgcgtccctgcttttagttgtcagaggtcagacagtaccctaatttctctgggcttcgactgccccttcctatgctggaatagcaacatcccagagtggaaaaaggagccagcccagcgtcctcagctaacggaggcctccttgctggccgccagataggccaccccgcagatacaggaaccaggcacgggcccgccaccctgtttccagggtctgagcgggtcaccaggtgagcacgccccagagctcaaaactcgtcgctggctgccctgcgtccacccggccgactactggccatggagccgcgcacagggggcgccgcgaaccctaaggggagcagaggaagtacagggattggggatgttggggaaggacagagcgagtcgccgccacccccgtcccgcctgtctgctccacaccttttccttctgacaggtggtaaacagagcggctctggcgcccaagtgaaggtggcagggggcaggggcccagcgatggaggctgggctggaggtcccctacccacacccacacacgagggaaagggccgcgcaccagagcaggggaggggctctcaggagtctccagggagacgtgcagatgtgcggggaggggtctgcccgtggtcactggggacacctgggcactcagggtcttagtgaactggggggaggggagctgggggcccctggggacctgtggagggggactctggaggtatgtgggccatggggggaacgggccctctgagggaattcatgggggtagcagcggttgcctaggatacttagacggggaattgggggttccggggctacggcgtcaggccgtgttctcccaggatatctggggaaatggggtcccctgagatatcgcgggcgaagagttgggcatccagggtgattagggggcagtcgaggacctcacggggtgttcggaggtgtctaggactattgcagtcaaacagcgatctccagggacaccgtgggagcaagcgggggtgcaccggctacccgcgacggtcggggatcgcgtgaggggagggacagcagtgacctccgaaactatcgagggagtggccaggggtcgccgggtatcctgaggggcatttctaggtcttcgagcgtccggaagcataggggttggccgaggccgagggtcggcgttgacctgtcccctcttgcgcgcaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggagggtgagtgactggcgcagggcctccgctgggggagggttcggagaggagttgggttcagtgggacaggcctggggggtcagcagctactgccctgtcttgggtggggccaaggggcgcgacttggggcggggatcggagggtgcttcgagtgggaggagccttggggttattctagcatattccttgagggttattgcagtcggcgagggctagattagatgagagtgcggaactggacccccgttctggcggcggtcctttttgaggaggcagggcctggagagtgcttggggggcgggcacgcagcgaaggggcaggcctgaaatgtgagtcacgggggtggagcctatagtcccatgggggcggggcttgagatgtcaggaatgggatgagggttagaggctaattagagggcgtgctatggaaggttcaggagccaaattttggagtagcattctccagggtgggccgaatggtgttgtttgagggatgtgttctgcgtgttattagagggagataggaaggcctggaagattattcacatggctgagcccaggattgtttattaagaaggtggggtcagaacagttaatttgtttgggctgagaacctttaagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacatagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtgagccctgaagccccttccactggtaggtgctatccctgcctttgttggggtgctctccttttgcctttccaacacgactgcattgcactcctccaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttggtgggtttcccaagggagagaagtcagagatcagtgaggagaagggagaggttcacagagtggagaagctgagattctgggtgggaagggtttggtggtctctgtggggagggtctgcaagaggtcatggtattctcacaagtaggggcagggaggggtacagggtcccaggataggaataacgtaggggcagggaggggtgtcagtctcgaggataggaatttcagagggtgggttttccaggtactggggggagagaagggaaggggtctaggataaaagcaagtgtttggaaggaagggtcttagttctcagaggcgaaggcagagtggatcttagccgggggaaaatgggatggggatccagagggtagggggtctagttctgaaaaacaaagggtcggtggtttgggagtcaacggaggtgggatgagagaggagagagcaggggctcctagatgagcggggtttgatttcctttggagattgtgggaaatgatttctgaggggcatgttctggatccaggaggggaggggtctcgggaaaggaggtgtcggggttgtgaggggtggtgcccatcccagaacgcctgtcaagggagatttctctcaaggtcagggtctcatctcccgcagcctttgggttctcctgtccatcctcagccaaaggcctggatttcccttccctacttcaccacccaatctaatccgtagtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagttcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaacccaggaggtggaggttgcagcgagccaagatcgcaccactgcactccagcctgggtgacagagcgagaatcagtctcaaaaaaaaaaaaaaaaaaaaaaaacttcaggccagacatggtggtttgtgcctgtaatcccagtactttgggaggcggaggcgggtggattgtttgagcctacaagtttgataccagcctgggcaacatagaccttgtctctacaaaaagtttaaaaattagctgggagtggtggctcatgcctgtagtcccaactacttgggacactgaggtgggaggatcacttgagcctgggaggtcaaggctgcagtgagccatgattgcaccattccactctagctggagtgacagtgagaccttatctcaaaaaaaaaaaaaaaaaaaaaaaaaggccaggctcgtggcttacatctgtaatcccaacactttgggaggccaaggcaggcggatcacctgaggtcaggagttcgagaccagtctgaccaatatggagaaaccccatctctactaaaaatacaaaattagcctggtgtggtggcacatgcctgtaatctcagctactcaggaggctgagacagaagaatcgcttgaacccgggaggtggaggttgcggtgagccaagattgtgccattgtactccagcctgggcaacaagagcaaaactccttctcaaaaaaaaaaaaaaaaaaaaaaaaaaaaaaaaaaaaagacaatttcagagagaagtgagagtcatgaagctatgaagctagcaaaaggaggttacattgtgggagatgatggtgagcttctggcctctttgaagacataactcttgagctgcaacctgaatgaccagaagccaggtatatgaagcactgagtgaagggcattgacagcagggggaatagcaagtgcaaaggtgttgaagtggaaccaggttcatcttgtttcagaaattcagacgtgtcctcacagagttggaaagcacatactcatcactaggaaaagtatgtttcatcccttccactattcactcactcttccggcaaccggggctgaaagaggggagctctttccttagttttgaggggccctgtgttggcagagagagcaggcaggcccttgggttgaatcctcctggccatccagttatgattctcccccacttcaaatgagatgagaataaaaacaacttctagtctggagagtgtgtccctcagggtacctctgggatcctgattccaggagacgagatgcatgtcttagatgcagaaattaaggctgagctgggggaaattacttgctcaaaataacacacttagccaggcgcagtggctcacgcctgtaatctcagcactttgggaggccaaggcgggagaattgcttgaggtcaggagttcaagaccagcctgagcaacataacgagaccttgtctctactaaaaaataaataaatacaaacaaagtgtctacaaatgtcacccagccttgcaccccaggagccatccattcatcttgccaatcccccagaaataaactttcctattcctcatgtacgattgtgccgactggcccctctcttcagaaccaggaaactgaggcccaacatttagggccaggacttccttgggattgcagaacacagaatcagaccttgggctctctgggctctaacactactacaaaatatgtttttttaaaatagagacaagctctcactacgttgcccaggctggtctcgaactcttgagctgaagtgattctcctacctcggcctcccaaagtgctaggattacaggcatgagccactgctcctggccttgggctctaacacttgaaacaatgcttgccctatttctgagcaactcaatgctcaccaacccctattctcacacagcctttacactggcagggtcttattctcatcactgctcagaggtttattccactgtccacaatccattatccaaaaacaaaaagctctggaaactgatggttttcccacaagataggcactatttggttacaaaacctgacctgatctaacgaggaacaattttctttcttcctttctttttgtttttccttttttggagacagggtcttgctctgttgcccaggcaggagtgcagtggtctgatcatggttcactgcagccttgaactcccaggctcaagcaatcctcccacctcagcctcccgagtagttgggattacaggcacgtgccaccatgcctgggctaatttttttcttttttcttttttttttttttttttgagacggagtcttgctctgtcgcccaggctggagtgcagtggcgcaatcttggctcactacaacctccacctcccaggttcaagcgattctcctgcctcagcctcctgactagctgggattataggcgagcgccaccacacccggttcattttttgtgtatttttagtagagacggggtttcaccatgttggacaggctggtctcgaactcctgacctcgtgatctgcccacctcggcctcccaaactgctgggattataggcttgagccaccgcgtccggccgcctgggctaatttttaaaattatttgtagagatgaggtctcactgtgttgccgaggttgatctccaactcttgggctcaagcgatcctcccacctgaggctcccagagtgttgggattactggcatgagccactgcgcccagccgaggaacacttttcaatccttacccagttattgtgaacgttcataccttttcttgaagaaataccgtttttgttgttgttgttgtttttgagacgtagtttcgctcttgttgcccagactggagtgcaatggcatgatcttggctcaccgcaacctctgcctcccgggttcaagcgattctcctgcctcagccttccgagtagctgggattacaggcatgcgtcaccgtgcccagctaatttttgtatttttagtagagacggtgtttctccatgttggtcaggctggtctcgaactcccgacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggggtttccacccttctcaaagtgggcgccgcctttgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaatttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggcatggtggtgggcgcctatagtcccagctactcaggaggctgaggcaggagaatcacttgaacccagaagacaaaggttgcagtgagccaagatcatgccactcactccagccccagtgacagatgggtgacagagtgatactgtgtctcaaaaaaaaaaaaagtatgacttgaattgtgccccctacgggtagggccacagtgtggcctccctgtgttgagaggtataggaggagggagagtggggtaggatgcactctcttggcctttccctggcttaccaacccggtgcttgagtcccatcctgcgtggggcaggtgctggaggtggtggatacaagaagataagagactgagtaacctgaccagctaatctaaaccccctcactcctatcctgtcccccaggtactgggcctaatcgctacgtgcctctttggctatgatgcctatgtcaccttccccgttcggcagccaagacatacagcagcccccactggtaagtgtgtgtgtgtgtgttggttgggggtaagggggttgctgagagggcagagggaaaaaggaaagggatctcttaaaggcacgaatgccaactctggtctcgtattggtacttagggcttttgtaccaataggtaccataagcttcggtattcttgtgtgtaaaatgttcatggactttggatcttgttttaaaaaatgggcatatagattcagccaatgctttctctcttttcctcacctgcagaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgagaggcccggtgcggtggctcatgcctgtaatcccagtcctttgggaggctgcgggaggattgcttgagcccaggagttctagaccagcctgggcaacatggcaaaaccccatctctaccaaaaaattaaaaaattagctgggaacgctgacacgagcctggagtcccagctacttgggaggctgaggtgggaggatagcttgagcccaaaacttttgaggctgcagtgagccctgatcacaccactgcactccagcctgggcaatagggtagaccaagtctctaaaacagaaacaaaaatagaaacaaactgataaaggagggaggaagaggatttatgacttaggttgtaggggcggggcgtgggggtgaggggcatgggcctcatcatctactctgactggagaatggagccccctccaggacggcctgccttcaagccacgatgcagttcttgtctcgggcctgacgaggcatccctgcgcgagagtccctggggagcgataaagatggggagttgaaggtctccattgcagtgtcctgagcaggcatgggcctgcacaaatgcgggggcagagggatgcgctctcctaggaagaagccatcatcctctgatgattcggaactggaactggagggcgagctggagcaagattccgagtctgaccctgatcccgcgtcacattgatagtggcgacgtctgcttgggtggcggttgtgatggtgatggtgattatgatgatggtggcggcgacggctgggggccctgggtgggggactgcgtggcctgcggcgctgggccgggggtgcactcagggtccggcgcgggcctccttcagacaccagagggtcgcggaagctgacgcgtggggtgctctgacgaccgaaggcactatcatctgggcgcaggttaggctggccgggggactctgggggcggctcggggacactgcggagccccagttccggcatggagtggcggtggggagcccctctcagaaagcgggagggctcctcagggcctgtagctgttaagggggagacagagtgactccttgtatctgccctcccactggccccctcctaagaggaggcctgcggaagggccttctttcctccactaagactgggaaagtgggggcaggggtcggagaatggcagggaggtgggaagtctgggaagtgtgaggcctggagcaggctctgggtgttgagagggttggaaggaagaacacggagcaagatgggactggtgtggggggcgtggccagggcacccggggtggcttcggatggaagaggtgtggcataggctggagtagatttggtttgcaataaaaggggtggggcctgactgcagaggatgaagggtgaccggctggagaagaggaagaggaacttggggtcaagcagagacaagttgaggtaggggaccagccctgtattgacagggtggaaccagggttcatgaggcgggtgtagtttgggatggaaaccaggcctggactggtgtggggaaggaggatgagctgagaaatgggcggggcccagggatacagcaggtgaagggcctgggctagtcaagaaggaagggccagggctgaggcaggggcaaggacataggggtgactgggctgtggctgggtgtggctagagggttagctcacctggcgctaactctgtgctggtgcctttggtggtggtctctgatgcccccttcacagcagagaaagaggctgtggaggctgcaagtggggctgtgacagggccggcactccagctgcggcggctcggccctggagctgtgggctcggacccaaggctgcaggctcgagagcagaagattaggcctcggcgtggcaggaatgggcggcccagcagggcccgcccacagcgactacagcagaagcagcggtctgaggcatgccagtgctggccctcgtaagccatctggccttggtccaggcctgtggggaacgacgagggggaaaaactgaggcagaacccccaggcgtaaccccacccctcgtgaacgagtcccttctcaagaagaggtggggaatccgaggcagggcacccctgggtgccttcctccctcctccagaatggggcccttttggagaaagcaggaaacaggttttggttctctcctggagactggctggtgaacctctctctcactcctccctttctttcccagggtgctctctcccagagcggggtgggcattggactctaagattcgggccaggcttagacattagggggtggctccaagtggaaggagaatggaaagctgggcctgaagaggaggcctggctggtgggggcagggcttagcaggtggggagtggccctgttgagaaaggagtggttctcagaggatagggtgtagctagaagctaggcctgacttaggctgatacaggagagtggaggagaacggggcacagcttggggtggtaaaggctaggagtagggcgagccctggggctggaattagagcaccctctggaggtgggtgtagacatgtggtggtggcctagcattgtgttaggtggggtttagaaagcatggcatagtggggacattgggagtgggacttgcaaccaagcgtacaggtctatagtgttggggctggacaaagtacagggcacaatggaggatggggcctggaggacaggaggagtcctggtggggtaggactgtggcccagctgtccatccatccctctgtccagtcccacagcattcacccaccgatgtgctccccacagccatcacagtactccgcgtggcgggcctcgtagcaggcgcagcagtgggggcggctctgacgcatgacatagcgctgccctcctagtgaagcttcacactcaaagcagcagaagtgatccatgtgccagtggcggccctcagcctccgtgcactcaggggagaagatgatctggagggcgcaggccatctgtggctgtcagatgagcctgctcctggccctgcccaccctcaactcccacccctgggcagggaggcccaaacctcgtcacaggcttggcagcgtggacgcaggcattcggcatggtgacgcccgcagtagaccttgccaacatggtagaagtagatgaggtcaaccagcagttcctggcacgtggtacacacgaagcactgtgggtgccagcaggcacccaggcctgcacggctggcaaacactgcgatgtccccacctccaatctgctttccgcactgccatgagacaagcaccaagatggttaccatcactgtcaccaagatggtcagatggatggggtcagccaaagtatgttacacttgggcctttcccacagtgaaactttgtgatcagccccacccatggggtaactttgacacaggccctgcctataccagggatggggttgggcggtaccttagagactgaccctgctcatgagggaagccgtagagacaggccctacccatggtgggtggccttataggcaagcctccctcatcaggggtggggaagacagacaggccaggcctagtgggggaaaccacagagatagtctccacccaccgggaccttagcaatagatctcacctaacagtaggatctaaggacaggccctgcttaccactgggccctgcagacaggccctgccactgtgggtcagctcttgaggacaagttctgaccacaggaggaccaaagagatagcccatgccccatgtccactgcacagacggggagaaaaacacactaaggcctccttacagacaaaccccacacgacagtgggattgatgggacaggtccctgtccaccaggggttgccttagagacagtccctgcccaacagtgagatgtgaggaacagaccccgcccacaagaggggaccctagagacacctcactggggcttaagtggcaggcctcatcttcccagtgcttggaagatgtgtcctgctccccagggcttggagcagaggcactgctcactcgctgaggccctccacggctcacctcctcacagatggccccagtgatggtcaccgggaagatgcgcacgatgccacgccccagattctcccgcttccgctgctggctaaaggctcggagctctttcttttcctcctcttccagtgctgtgcagtactgtgcctgggaggagaaggcatctcccaggctcctcccttgatgcctgtccctgcccctcttccagacttcatccatgccccgcaagtttacttctaggtctttctatagatggtgcctcctgcctgaagtaaccacctcttcttccaaggcccagctgtggttttgccaaggaatgtcccctgatgacccctgcctgtctggaccactcacctcagatcagctcacctttcctcctctgaccctgccctgcattggcccaggctgtgtgctgtgcctggcatgcccttcctgtcttctctctcctcacctcactgtcgtgtgggggcagctggtgcagcagctgcttgatcctgtatttctccccaggactgttgacgtaggggaccttgtcctctgggaggcagctgaaaaattgatatacctgggaggacataggagtgggagaaaacaactgaaatgagaggtgagttgggatgcagtgagatggcgggtccccatttctcagaaaatgaaaggcattaggagggaccttctgactccctcatctctccttcctaaaggcggatcatttccctcagctcccagctcccaaacacgctgagggttcctgcatgtattgacctcacttcctcctccagctgctgatcacctttttttttttttttttttttttgagacggaatctttctctgttgcccaagctggagtggcgcgatctaggctcactgcaacctccgcctcctgggttcaagcgattctcctgcctcagcctcctgagtagctgggattacaggcataccactatgcccagctaattttttatttttagtagagacagggtttcaccatgttggccaggctggtctcgaactcctgacctcaagtgatccgcctgccttggtctcccaaagtgctgggattacaggtgtgagccaccgcgcccagtctactgatccacttttctttttccctttacaggaaaattcctcaaaaagttatgagcacttgtgttcactccacttcctgtccttccaatctctcttgagcctacttgaggcaggcttccgctcccatccctcttccaaagctgtcaaggtcatcgatgacttccccattgttaaaatcattgttcaggtctcagtcgtcatcagacttgatgatggtagcactgcaccgagctgaccactctctcttcctggaaacactttcttcccttggcttccaggacaccacacagtccaggttttccttccaccttattggctgctccttctttgtccctgttttggctcctcctcaactagctgacccctaaatgcaggaggatcctaggactcagctcttggtcctcttgcctctgtctacattcaatttcttgggaattacattcaaccttatggctgtaaatatcatctacttggctggctaatgtgtcacctccagcctgtgacacataatgacaaacacatacgtccagctctgtaacttatcccttgagttccaggcaatgtggctatttagatgtctaacaggcatctcaaactccagatggccacaaccaaacttatgctcttacccctcaaactgctcctgtcttggcctctcccacatcagttaatctacctatcctcagggtcatctttcactcctctttctcccacccccacaagcaaatcctctgagtgctacttccaaaatataggctgggtgctgtggatcacacctgtaatcccagcactttaggaggcccagaggggaagatagcttgagcccaggagtccaagaccaccctgggcaacatggcaaaaccccatctctacaaaaaatacaaaaatcatccaggcgtgatgatgcgtgcctgtagtcccagctacttgggaggctgaggtgggaggatcacttgagctcaggaagttgaggctgcagtgagctgtgattgagccactgcactcaaacctgggagacagagtgagacccccccccatatatatatatgtgtgtgtgtatatatatatatatatatacacgtataattattatacgtatattatttacgtaaattatatacgtaaaataattattttatatatatgtatatagatgtatacatatgtgtatatatatgtgtatatatacgtatatatgtgtatatatatacgtatatgtgtatatatatacacgtatatgtacgtgtatatatatacgtatatatatatacgtatatgtacgtgtatatatatacgtatatatatacgcgtatatatatacgtatatatacgcgtgtatatatatacgtatatatatacgcgtgtatatatatacgtatatatatacgtgtatatatatatacacacacatatatatatatattaaataattatttattaaacggaattttgctcttgttgcccaggctgcagtgcaatggcatgatctgggctcaccgaaacctccgcctcccgggttcaagcgcttctcctgcttcagccttccaagtagctgggattacaggcatgtgccaccacgcctggctaatttttttgtatttttaatagagacggggtttctccatgttggtcaggctggtctcaaactcccgacctcaggcgatctgcctgcctaggcttcccaaagtggtgggattacaggcgtgaaccactgcacccagcctattttttttttttttgagacagggtcttgctctgtcgcccaggctggagtgcagtggtgcaatctcagctcactgcaacctctgcctcctgggttcaaggaattcttgtggctcagcctcccgagtagctgggattacagacatttgccaccatgccagactaatttttgtatttttagtagagatggggtttcactatgttggccaggctggtctcaaactcctgacctcaagtgatccactcgcctcggcctcccaaagtgctgggattacaggtgtgagccaccatgccggcctttctgtctgtctgtctgtctctctctccatatatatataactccttgcactgccagtgccatcatcatcaggttcctcactggtctcctgattccacccttattcctccaggctgtcttctgctgacaaccctcttgcgacttcccttcattcacaggcaaagccaaagtcctctccatagcccctgccacatctctgacctcatctccagctggtctcccccttgctcactctgcgccagcagcactggccttgccatcccttacatatgccaagcacacgcctgcctcagggccttggcattagccatgccctttgcctgtgtgaatcgctgtaaccttagatgtctgcatggctcacttctcacctcctttcgggcagctcaaccattaaattctcacagaggcttattctgggcaccctatttacaattctagcatctctctccttccctctctctttcttcaccccaccttccttgctttttaattccatagcccttacaccatctgacatatatttacaggtttgcttattgggtgttcctcctttccagaatctaccctctgcctgggcagattttttttttttttttttgagaagtatcactctgttgcccaggctggagtgcagtggcacgatctcagctcactgcaacctccgcttcctgggttcaaacaattctcctgcctcagcctcctgagtagctaggattacaggtgtgcaccaccacacctggctaatttttgtacttttagtagagacggggttttgccatgttggccaggttggtctcaaactcctgacctcaagtaatccgcccgcctcagcctcccgaagtgctgggattacaggcgtgagccaccgtgcccgtgggcagatatgttattttgtgttttgctcattgctgtgtcctcagtgcctagaacagtgtctcacatgcagtaggtgccccataactatgtgttgaatgagtcaatcaatgaagtcatgtggtgaatgaagtgctgggagggtagaatagggagtggggccacgcatggtggcttgctcttgtaatcccagcactttgggaggccgaggcaggatcacttgagcccaggagttcaacatcagcctgggcaacatagggagaccctgtctctacaaaaaaattttaaaaatagccaggcagggtggcatgcacctgcagtcccagctacaagggaggctgtggtgggcaacagagtgagaccctgtctcaaaaacaatcaatcaaaaataataggattggggtgaacaggccctgaggaactggtccctcagtcacccaaggtatggggggctgaccactcttccatcacagaggggccagaaggaccctcggtctgactgcacactctagcgtagccccagaaataggttcccacctgagtgtgtgtgtgtgtgtgagcattagtgtgcacccactggacagcaagagtggagggctggcctctggtcacctgctccggcttaaggcctgggggcacccaggcatactcctccgatgcacagcctgagtcgtcgtcggagatggagtggcgctggaagtccgagattagccgacacatgatgcgttccaggtccacaggcaccgcgtgcactgcatgctcctcccgcgggcatttgcaatgctggcagatctttctgagggggccgggatgggggtcaattactaaggagttgcccacccgaacccctcggcagcccaggtccaatggaggagcggggacatacagattatcaccaccaaaggtctgtgagcagggacagggatctgggcctgggggcggggctgcaggaggtgggcctatgagccagggtgtggctgggctgtgagccagaggacaggtcgtggggagtgggatgctttgtgggggaactttcactagacacaggcatctaacctgtggtgaggctctgaacttgtgggctctgagcctgtgggtagggcctgagtctgggggctgtaggctctgtttattgggtgcagggctccagcaggaggataggacgctgggcctgggagagtaggtctgagtctaagaggggtgctggaggccagagggcggcgctcaaagttagagacgaagaatctccctagggatgcgactccgcggctacgggagaacacttctgggggcggggctgcgtagtgggtggagctctcctgggaaaggactttggggaatgagtcagggggcggggctctgaatctgagcctgaggctcttttcccaactgagatccctctgtaggcggagctcaagcgtaggggcgtggcgtaaggctcctggatttccccccgaaggcggagctctgacaaaggcgaggccctttaggggcgccacttacctccagccgtggagcaggaagccagggcactgctccctacaggagttgcagggctggccccggtctgggtcctctgcctctggaggctgcagtgggcgggggcagatgcagggccgggtgaggcgcggaagcagggaaggagaagtcaacgcccgcccctccacttcattgcccgcgaccgcacgctggggcctgtcttacctgggcagcgctgggcaggctgggacagcgcccagagtgcgggggagcgggacacaaccgaggcagaggcggggcagttggagccacctccttatatgtccccttttcagggaattccccttcctaggctggcctcggacccccctccccgtccgcccctagcctcagacacctcccaccagccttagatccttccagggctcaagcacctcccctataattcattgtactctccccactagagcacagaacccctactctgggcatcctctccccggcctcatcccggttccctctccatctacgccgccagcagcactccagttccacagggtaggagacgagaccgcattcttccttgagatccccacgtgaaccctgcccctctcttcagaagctcaggagctcctcccctaaaccctggcctcatgccctgatacccaaggaactggggaccctccccaggatctcaggaggcccctgctccattcagaaacccccatcccaagaaaccttggcctttacccatcccatcctagggctatttattccttctccggaccatcaaacccagaccccacattcccaggtcagagacccactccaaaggaagtgaaagaacctcctgtctaagaagtcaaaaactcccttgctcaggcggaaccctggaagccttgtccccccaaatcccagtctcttgactctcagcatttcggcatcccaggagtgtaggactccatccctccgtgcacattcctccaaggtactgtgtcctttagaagctgaggaggtcggccaggctcggtggctcacgcctataatcccagcactttgggaggccgaggtgggcggatcacctgaggtcaggagttcgagaccagcctggccaacatggtgaaaccttgtctctactaaaaatacaaaaattaggcgggcgcggtggcgggcgtctgtaatcccaggtacatgggaggctgaagcaggagaatcgcttgaacccaggaggcggaggttgcagtgagcggagatagcgccactgcactccagcctgggtgacagagattcagtctcaaaaaaaaaaaaaaaaaaaaaaagcagcagctcaggaggttcctgctcaacctaaggcttcaagacccagttctctggccctcaggattccctcccacaattcataagagaggggtccccaccaggtcccaggagtgctgatgaaagtgtgtggagaggtgattagggggtttgggccaccagatctacaccttcctccatccattcgcctccagcagccccagccccaggtctgggaatgcaggggatgggattcccagatcctctgtggggcacctattcgctatgcctatccattgcccccttgcctgggcctcagtttacccccgacccccaccgctgccctgactcccgctcaccgcacgcccggagcggcgcctccgggacccacgcgcgaacatggcgcgcccgggcagggtcaagccgggccgggtcaggcgaatgtaatccttgcgaccgtcaggccaccgcgcgtccggcctgggaactcggttccgtaaacctgacaccctcgtgggaggagcgcgccccgcagggcccgcccccgggcatgtggtctctccgctgccagggcgccccctgcctagaggtgaactgcacgtagcccggagtgccccgcgggaaaggcctctgccctcccgctccgggccggtgcggggcgtcacaaggcacgacccccagaatcccggcgtgccacgtggcctctcacgggacctggggcttgaaggttctgtagtggaggatggggagactcagaggtggccaactggactgagaggggtggcgcgctagggtgcttgtgttgacgttttgtgtcgatttatttcggatgcttatttgggagaggggttaaagacacctcttggctcctccccactggtgaggttccgagggtctccccgatgaatgctgcaacaatgggccccaacctcacccgcagccccagctggtgctcgctgggaacctgggaacctggccctagccaccagagagctagatcttatacgcactcctcccttctcattcccctctcagcgaggccaggttccaaagccctcgtcccctctctcccctcatccttataagcctagctgtccagccccgtccccccaccccaagtcttgagaagtagatcttaaagccttccctcccccacccacatttttctctctccagttatccccttccccagctcagttccagggcggggagcctctccttcacgctctcaggcttggctgtgcctccgggctggggggagggggtcccatggcctcagtcagaactcggcccgggtctctatgcacggagactgcagcggccaggcccttcatcgcgggccccggggacctctccccgccccccattacacatgtccctgtcacttcccgtggagtggagaggtaaaagagaataactaatgaactaaggagtcaccccggcgccccacctcccctccttgcctaacctgtctcccatttctccagcctgggcggaggcagggaaaggagagacagtagggtctgaagattagggatggggtcaggcaatgtgaggtttcctcctattcggaccccttggggatttgaggagagggttccacaggggctcggaagaggcttggctaagggaccagaattagaaccaactcctagaaagaccgggcatttggtggccagtagtgggagggtgagcagggctactcagagagtgacagagtgattggcaggagaggcttcccagaggatgctgctctgcctaacacttttgaaggggcctgaaatggtgcagcaagctgaactgcggtcggtgggtccgggtggagcttgttctcaccacctctccctcctttctcccccggccaacctcctccccggcgcccgaaaaagacacactgagaaatcagagccgggtagactaggtggttaaggagtttatttgggagaggagaatcatatttgttcttccttggggaggggggttctttgaacaataccgaagggtttgggaaagggtaggggtctggaggggagaaggaggggccacagccagacaaaatggcaacacacgatcacaggcactactgacatcacagacatagcagagggtgcaggataggggctccagaccaggcctccaaccaccccaggacgggtggaggtgtggagggagggagggcgcaggggaagggggaagaggggtgggccagtcccacagacccgttggttctgtcctcctattaacctagctgtttcatcacgggagtggggaagggtgtgtgtggtggggtgcttctctctggatcccacgcctcaccctacaagccatatcactcgactcttctcaggccacttccgtcccaagtcgtagccagagccattctcccccacccctaacaaaacccatctggaagctcctatccaagtcccctctccactgcccaaacccagccattgtaaaacattttcttcactgcaccatggggaggggctgccctttctgaaaccaccatggaagccccattctaagccccaccctgtctggaaccctggcttggcccattcctgaatcccacttcttgccttgctcaagatctgtcccctttagaatcaagctcagtctcccaaatgttccaagccacaccctttccataggctctggtaccaatccaagacccacctactctggagcccaccattctgcctcgcttaaagcctcgccccttctagaaccctgccctcagcgcccttccaagccccaccccagaatgctctagcgcactcctctccttcagactccagatccactctgtctggaacccaacccccctgctgacccctccactccacacctcctctccaagaccaccttgggtcctaaactgtcctctctaccccaagcccccccaatctctgcctttctttaaccctggagttggatttccctaacggcctttgttcaggcaggcattgctggaggaaccaaggccagagttgggaggagtggagggagagagaggagagagtctgaagtcacgcccaccctccccacacagccgaggtctgttccctccctgtcctccttttagatccccttaacctcaggggacagggagggtaaacagagaggggccaagggatgcagggaaagggacggggtaagagagggggcccactcaagactgggcacctagtggatgaggggagtggagtgagggcagggctcagacagataaatagatatttatatataatatatatatatataaacagcaaagacagggtctcctggcttgaggggtggagacctagggtataggggtgggaaggggggcaggccttctcctgagctcttgccccccccaggtcctcctgggcttcactgacctgtagagacaaaagacacagaaaggagagggggtctgacatgggtggcgccctcagataggggttgggctgttatgcctttgtcctggctttatgtcttttcttctttcctggagccagcttcatcccagctgcctctgctgagaagatatacctgaccttgcccccactgggttaggtaccaaagagattacagtctccttcctccaaccaaaaaaatagtcccttaacaggtactgttctagccatttgtgataaactatattgagcaaaacaaagatccctgtctttgtggagcttatactgaagcagagatagacttcacacagcgaacatgatgcatgagtggattatctcgtataacatagggtgacaataataagtgaaatggaaaaaataaagtgagctgggcatggtcgctcacacttatagtctcagctacttgggaggctgaggtgggaggatcacctgagcccaggagttcaagtctagcattcctaaagtgctaggattacaggcgtgagctaccacgcccagcctgcgacagggcagagttctgacacaggaggactgtggcctaatttaggatttaacagaatccctccagatgctgtgagtagaacagaatggaaatggagacctgagaagaggtctgggagagatgacagtggaagatgaaggatatattttttgaaggtaggacccacaggattttttgatgaattagatgtgggatgccctttccatcctggctaacccagtgtcagaagctacctccatccaagtattgccaccttcttgccttcccccactttttagccaccccttagccttttcctcctgcctttcctcccctatatcctccctcctatctgagggaaatctcacttctctttttctttttttttttgttttgagacagagtctcgctctgttgcgcaggctggagtgcagtggcgcaatctcgactcactggaacctccgcctcccagattcaagcgattctcctgcctcagcctccagagtagctggaactacagacgtgcgccaccatgcccggctaatttttatatgtttagtagagacggggtttcaccgtgttggccaggctagtctcgaactcctgacctcaggtgatctgcccaccttggtctcccaaagtgctgggattacaggcatgagccacctcacctggcctcttttctttctttctttctttcttttcttcctttctttctttccatttttttttttttttgagacaaggtctcgctctgttgcccaggctggagtgcagtggcaggatcatagctcacggcagcctcaacctcctgggcttaagtgatcctcccacttcagcctcctgagtagatgggtccacagatgcatgccaccacgcccggctaatttttgtattttttgtagaggtgggatttcatcatgttgcccaggctggtctcgaactcttgggctcaagcggcccgcccgcctcggtctcccaaagtgctgagattacaggcatgagccaccaagccccgaccctcacttctcttttaaggcccagcaagaaggccggcaaacctttccagaaccccaccctatccctcttcctcctttgaaattccacactacttccctcccctccagcgttggggagaggcggcagatctatcccctcctcccggattggtgagctcgtctgaccttcaagatccacgcccatttaccctcaccatctattggccttatcacctattggcttatcagtcacttctaagacccacctcctcgtcgcttccgtggctcttgcgctccgctgattcgccactgcgcaagtcccccgatattccctccctttattggttgctctgcttctctccccctgcctttccgccgagttgcccttctacctccctcccattggctcttcattctgtccatcttgaagcaccattcttcttttctccattcattagctagtttttcagctcttagcaggtagttctgcctcttgattggctccttcaaacttcagtccttacttgccccagtaaacgccttacgtactctctacccctgactcttattggttcactgacccgctcgtctccttccttgtaccctccttggccgcaccgctcgccggtcactcaccagactacatctgattggagaaggaggtgggtgcaccctgcgggccgtagccttgctgcccatagtcgccctgaggcccgtagccactgccaccgctgccggctggttgaccatagtcaggctggtagccgccctgaggcccgtaggaatcctggggcccgtacccgccggggccctgcccgtagcctgcatcgccgtaggcgtccccgggtgccggttgtttctcgggggcgccgggaggcgcgcgcaggaacggggcggcccagcctgtctccttaaacacgaaccacaggttgccgacccagagcaccaggttcaggaagccgaacacctgcagggagacaaggctcggctgtggtaccccgcccattgccttggcggccctgcgtgcaggaatgagcatgcggggaatgaatccgtaggctccgcaaggtgggggtttctgaaacccagactctctgagtcccagtgcgagaacgtcgatgtgcagaaaaatcacctctggcggggtgggcgtgttagaagaatttggagccctggggatgctgcgatctatcagtattacatatacaattatttacatatttgcacatatacacattatatacacatttatgcatgtttaaaatgtaaatttgtaatatattcatagtaaaatgtaaggatacaaacttattaaatatagctataccactaacatgcatctaaataaatgtagataaaatatatgtataagtgcacatgtataagatatatgaaacttgcataattttttttttgagatggagtttcgctcttgttgcccaggcgggagtgcaatggcacgatctcggctcaccacaaccttcgcctcccgggttcaagcaattctcctgcctcagcctcccgagtagctgggattacaggcatgcaccaccacaccagctaattttgtatttttagtagagatggggtttctccatgttggtcaggctggtcttgaactcccgacctcaggtgatctgcccgcctcggcctcccatagtgctgggattactggcgtgagctaccgcacccggccacataaagtaattttaagacataaaacactttctgtacctttccttatatgccaagccctcttctaagagctttacatgttataagctcacttaaaattcagttttgggcaggaaatactatctccattttacagttgaggaaactgaggccctagaggctaagttacctgaagtctcacatccagcaagtgacaggaaagaaaagttgtaatcttagcatctgtaacccttgtatacgacttaccttgtgccaggcccttttctgagcactccgtattcttagttcaataaatactcaactttggagcaggacctattattagtcttcgattatgcatgctcaactgaaccttgagaggctgtgactagtttcaggtcagggagcttgcaagaggtagagctgggatttgagcgcagacagtctgactccagccagtagggggcatccaagtggggaaacatttcaagtttttccttcattttgcacatgaggaaactgaggtcccaagagggtgctgagttgcttattttacatgtctaggctgggtctgggatccaggtctcccaaacctgtcatgttccccctttggggacagtctgtggtgtcacagtggttacaattgctagctcatccttcaacgttgttgttggcacgcgttcttcagggacaccccttggatctcccctgactctcctcttattctcccactccaccactccccatgccggactgtactgttttccactctccctcctccagccagcacccagggcttaccaccgaggtgttgagtcccgaggtcacagggtctctcagctccttgcatgtgttccctgtctggcggcagacaggcatctccttgataatgttctctgggtctgtggccatcttcacatctgacagccccttggcccatgccgatgagctaactagccacatgaaggcgaacacagccgtggccagaaagtcctaaggcaggcaggggtgaggaagacagcactgtgagtggactgcttcacgctaggccctggggcctcctcggatcacaggtcccccagaagaggcctgtctctcccctgccttttcagctctcaagcccacaacactttcacctgaaggtggccctcccagcttgagcttgtgtgtgtacatgacacagaggatgtgggagtgtgattgtgatatgtggctgtgggtgttggggggaggggaactctgggatgatttccgaatctgtggaaagtaatgtgtctttctacttttgtctgcatgtgggaatttttgtcattttgtgtctaggctgagggtatgtgagtacagtggtgtaggaatcagtgtgtctgtgtggcatgatgacaggcatgactgtcacagcgaacctctgtgggcctcttcctttgatctaggctgtgtagttgtgtgagagtgggaaggttctcaggtgtgggcctgtctgggattctgcataggctgtatgtctccgtgactctatgactctgtgtcccggatgcctggtgtggattaatagcagcagcaactatatgtgtggctgttatggtggctgtttgcatgtgggcctgtctgggatttggtgtggtctgtgagcatggctgtgtccctggggttccgtgtccccatggtccctacatgcaagtggctgtggggactcaccagcatgggccctttgttattctctcggtacttgttctgcaggaagatgtaggtggccagagcccccatggagtagaggaaggcaaacacggccacggtgacaaagaattcggctgacgaggagtagtccccaactaagaagaccttggtggtgccccctcggcaggtgggtgcatcaaagtacacttggtgcagcctgcaaacagaggtgggcaggtgtggcccagcccctcagaacaccctcaaccctccagcccaatcatgggtccccccatttctgacaaggccccaggaagaggaggaaataaccattcatcgagcacctactatgtaccagtcacatttcactgattgctcaaaacatcctggtgagataggtgttattcatccctcactccaacccaagcactctggcctcttgattatttctagaacttgccaggcatcctccctccctaggatctttgtttgtactggctgttccctttgccaggaatgcttttcccctagatagcttcgggtcttactccctcatctcctttttttttttttttttttttttttgagatggagtcttgctctgtcaccaggctggagtgcggtggcacaatcccggctcactgcaacctctgcctcccgggttcaagcgattctcctgcctcagcctcctgagtagctgggattacaggcatgcgccgctacgcccagctaatttttgtacttttaatagagacggggtttcaccatgttggccaggatagtcttgatctcttgaccttgtgatctgcccgccttggcctcccagagtgctgggattacaggcgtgagccactgcgcccggcctccctcatctccttgaagctttgctcaactgtcaccttctcattgagaccttccctgatctccctacttaaaattaaattgaaacattctctcaaccagcacttcttagcctggcttccttgctccacttttctcgatagtagtggtacccatctgacgtaccaggtattttttttttttttaatcttggtttttgctgtaactacaagagggcagggctttttcctgtgttttcacctccgtttatctccaggccctggaacagtgctggcacctagcagacactcaagaaatgtttatcaaatgaaatgtacagaggcggaaacagaggctcagggaagtgcattaacttgcctaaagtcacacagctggcaagggaatgtcagagttgagatctgaaccttgttttctccctatctcatgttgacttttctcccccaccccagttcaggtccccgagagaaaaaaatgtatgcatagcagaggagaggccagcgactagataacaggaaaagacagacagaaagaaaggagggtaaagggatcttggaacagggtgtgtgtatgtgagggaagaggggaggtgtcctgggactaaggcctttcctgtggtgtgatggaggagaggtgggggttgtagagagaaaatgtctgtgggagaagttctggagcacagtctcagattggaggccaggatcctgagactgagcaaatggtgccaatgcctttgtgtagcaaaggccctgagggaagaggcttgcacttattagtcacctactaagcagtttacataaatgtctcattaatgacagcctccagcaattctctaaagaaggcattattagaccctttttacagatgaataaacagaggcttagcaaggttattacttgcccaaggttgtacagctcctaaatgatggagctaggagttgcatctgggtttgagtttctgtttctagtgggctgggtcaggagagggggtccctaagagggaatgagaggtccttgggtattagggcagtttgggagggattttgctcagggggacccagggccaagactgtttttctaggggacttgtgggctagagccttaggacccaaagttctagacatgggaggcgtggggagggggcacaggggatggttgtggtcttgtggatccccaaaggactggctctaagcagtgtcccttgctgccagctccccctccttccccagactcttttctcccttgcctttgtggacccatggatacctggctgcccctctgcctctcaggccacactttcccggcatctcctctcttttccatcattgctcagggcctgtgctaggttttcttctactttcactcttccatctccccactgggtgatcacttgagcctacatttaccctcagtactcgaagacccccagtttccaactcaacccctgtcctctttcctgagtcccttaaatttattttacttattgaacagacactgatggagcacttattgtgtgccaggcactgtgctaagcacctgatgaatattaactcattgaatgctaaccacgaccctgtgaggtagatattattagtattcctttttacagatgaggaaattgagacccagagtggttatgtgatttggccaaatagtgggggagtctcagaaacctgtgcggggattgtgtctgtgggtctctgtcatcccaccctgcaggaggtaaacatcattgtgagggtagtgcccatgccagccgtgctcattcttgtgcacctagcacccagtgtattgcccggcacacagtgtgagctcaataaatgtcagaattgtttaattgggtttaatttttccctatatctaagcagcacccctcattattctattctctaccataaaaccctacatgaggatctcctcgagtttctctcagtctgctattatcctctttgttaatttatttgttataatgtaggctccatgaaggtagggagttgggtctggtttttttttttttggagatggagtttcgctcttgttgcccaggctggagtgcaatggcgcgatttcggctcccaggttcaagtgattctcctgcttcagcctcctgagtagccgggattacaggcatgcatgaccacgcctggctaattttgtatttttagtagagacggggtttctccatgttggtcaggctggtctcgaactcctgacctcaggtgatccgcccacctcggcctctcaaagtgctgggattacaggcgtgagccactgtgcctggcgggagttgggtctgttttagttactatcatgcttccagcactttgagtagtaccagatataaaataagttctcaaaaatgtgtatagaatgaatgaatggggattaaataataatattggctaacattaattgggtacctactgggttaaggtatgtatatacacctgtcttacttttgtatcttgtttattgcctgtcccttaccccttcgctggaacagagccagagggccacagcctatgtctgccttgctcaccacatagtcctagagtccagagcagtgccaggtacaaggcaggtgctcagtgatcccagtggatgtagcctcgaggtgggagctgggcaggagctacttgcggggggaggtattggccggttccaccctgccccttcctctcccaggtctgttggtatcccagggtgggagcacacctgaaggggtactcgaactcgacctcgatgctgaggtcactctcggtcttgttggcacaatccacgctcagctggagctccccactgtagctgccgcatgtggcaaaggcgaagatggcgaagaccttgggcagcagggatggggatggccacagtgaacctgtgtgcatgtgggagggaggtgccctcctctggacagatcgggggcccagcacaggcagcagcagatggagcagtccccacccccaccccctaatcagggctcatcgggaccaaggacaagctgattacaagggtatggctgtctcttcctgtttctctctctgtgtctctctctgtctctgcctttccatgctgacctccctcttctctgtttgtctctgttgttctctgtgtatctcactgtgtctctgtttctctcggtatctctgtttctctatgtgtctttgtctttctcagatgtctctttgtctctctgtgtctctgatcctctctgcctctgcctatctgatctgtcgatgtctctttttgtctcttttttctctgtctgtgtaagtgtatgcctgtatgtctgtgtctttctgtttcttggtctgtttgtctctgtctctctgtcctgtctctcactcggtctccggatggttctctctctgtctccctcttgcctctgtgtgttggtttctcttttttctgagtgtctctttctctctgtgtctctctctccctcaccctgttttcctgcctctctccctgcgtctgtttctctttgcatctgttttctgtgtctcctttttctttgtttctgtttgtctcttctctcttatgtctgtatctcttctcatctccatatttcttttttttttctcagtatttccatctctgtctttatcattccctgtccctcattctctctgtcaccttcactgtctctgggtttctctgactttgcatctctcacccagcatctgctacaggctccacctcccccacccctccctcacttcaagagaggaggtaggacgtcacagtctcccacttcacaacgggggtaccctcagccctatgtgacgtcacagctcatctgttttctggcttcagacccctgaaacctcaccctggagcccaattcccccatcccctacaacccccgcactcatccctggctactcgcccctactccacccctgctcttctggaccccatgacctccctctctccctgcactctgccccaacagcccggaccacactcacccattgcagcaccttcacaaagccgaggggctccttgaccacccggaactgacccccagccaccagctgaggagagaaacagtggggaaggggtggggttgttggaggtacagggaggtgagcggcaaggctgcccatcaatgaccccaggggatggagcatgtgacctcggggagagggtgagaaggagaaagtgacaccttggggatggtgtgagccccagggtccaaggactggtgggaaggtctgaagagatggtgagtcagatggcagaggaagtcgggggtgagggagatggggatgaggtcaggactagttaaggagggggagcaggtttgaaacgtaaaggcgagtcggatggggaaggggttcgggtagagaatggggatggagtggggtgcattcgggtgggggggttgtgatggtgaaggtgagtcataacggggcaggagtcggtttggctcaggtgggggaagggtctgcaggggtaaaggtgtgttagacggcggtggcggtagatatttgaggtgatggggatggggaagggttgggactgattgggggtgagtttctgaggtggcaaagacgagagacatggcggagagggtctggactgattaaggtgggggagggctgggacacggcttcagtcgctatgtgttgggggtgaggaggctgggggttttggaaggagtaaaaccggattgtcccctaggtgtgctctgggggaaggggtggtcgcctatgggggtacagtctctgtttgggaggggcgggtgccagccctctcccccatccccgcccccacaccttctgtcgctctatttcctagcttatccgcagcaccccccatcttccttccactctcccctccccttgtcccttgccctcactccagcccccaggcccctattcctcccctcgcggtcgccagtaataaacggggctccgggggcccccgctgcggcagtgaggacggccctcgctgcggcaaagagcgcactccttttctccacctcccccttcctccccttcacctgccgcagacccccatccccagcgccggggaccgggtctccgctgccagaccctggccaccacctcccagagtcggctggcctgagcgacccggcctaggcagccgggcggcggcgggctctgtccacggtgctggagcgcgtacctgattcaccacgtccatgtccgccagcagcagcatcagcaatgcagggggcgggaggctcggctagcaagggcggcgcggggcgcggcgggggcggcgcgcgctcgttggaacagcccaggcggctgcagccccgcccctcgcgccccctccttgcccgccacgcgcctgcgcacagcgggttgtaccacagtctcaccggcagccattccggcccggaggctggagccgtgagagcgtgcgggaatatgcgttgggaaaacacaagtcgagggccggggagaggagacctccctgctcggtcctacagtgtgacaactttgccaggctcttttctgagtttgttaaacatgttcactcatttaatgcttacagaagtcctacgttgtagggactattaggccgtttttacagacgaggaaaataattccccagagagcttaagtgactctcacaaggtcagccagctactagctggcagtgcccagagtccctgcagtttaaacacggttcaaggccttccaggttcctttttcatagtctgcattttaagcacaccctgaaactcctgcccccatctagccatctcccttatttctttcttcctctttgtcaaattaatgcctactcgaactctaccactttacctatttattccttagctctctcttaattggaataaccctccttcctgcgactaaaactaggcccatcaaggtcaacagtgatggctatgatgcaaaatccaaaatacagttggggcttaagatgctcaacttcggccaggcgcagtggctcatgcctgtaatcccagcactttgggaggccgaagtggacagtggatcacttgaagtcaggagtttgagactagcctggccaacatagtgaaaccccatctctattaaaaatacaaaaattagctggctgtggtggcaggcgcctgtaatcccagccacttgggaggctgaggcaggagaattgcttgaacccaggaggcggaggttgcactgaggcgagattgcaccactgcactccagcctgggcaacagagcgagactccatctcaaaaacaaacaagcaaacaaaaatactgagatactgtttttcatctttcagggtggtgagtatcaaaaagtttgataacgttccgtattggtaggttggccagaaacaagcgttctcataaatcgcctgtggaagtttcattggtataacgtgtagaaggcaatcgggcaaaatctaaaaaaaaaaaataacaaattcatttactgtttggttcaccttcatacttctaggaattcatcttacagatagactcatacatgtgctaaaagatatatgtataagataatacatgactgggctgtttattttttatttttttttgagacggagtctcactctgttgcccaggctggagtgcagtggcatgatctccgcttactgcaacctccgcctcccgggttcaagcaattctccctgcctcaccctccctgagtagctgagattacaggcattcaccaccacgcccatctaatttttttttttttttttgtagttttagtagagatggggtttcgccatattggctagggtggtcatgaactcctgacctcatgtgatctgcctgcctcggcctcccaaagtgctgggattacaggtgtgagccactgggccaggccagggctgtttataataggataaagaatggacactcccaaagtgctcattgttggtagcctgtttaaataaactctgatactatgccgctgtcattataataacatggaactatggaatgattgccaagatatttagttaagtaaaaaatgcaagatgtcaaactgtgtggtaattgtgtacaaagagaagagaagggttatatcagacagagaatagctaacatttaaattgtggctgttttctgtcaagtactctttagagaactttgcctgtattactcacttaaattcttactgtaaccctatgtgacaggtacgacaactatctttgttttacagctgaataaactaagaggcggagaggaattttcctaagttcacacagctggtaaattggtagaaccaggatatgaacccaggaagtctggctccagcacctgttactcttagccactgtgctaacttatcagtacaccatcttttttttttcagcacaccatcttgtatgtctgtgaaagatacctgataatactatttgcttccagagggtagggaaacttttcactttatacccctttgtaccttttgagactccatctcaaataaaataaaaaaataaacagcctggtagtgtatcatcttatacatacaccttttagcacatatatgagtctacctgtaagaaattcctagaagtatgaagctgaacaaaacagtaaatgaatttatttttctagattttgcccagttgccttctacacaggttataccaatgaaacttccacaagcgatttatgagaacgcttgtttctggccaacctgccagtatggaacattatcaaactttttgatactcaccaccctgaaagatgaaaaacagcatctcagtagttttgttttgttttgtttttgagacagagtctcactctgttgcccaggctggagtgcagtggtgcaatctcagttcactgcaacctccgcctcctgggttcaaacgattctcctacctctgcctcctgagtagctgggattacaagcacaaaccaccacgtccggctatttttttttttttttttttttttttttagtagagatggggttttgccatgttggccaggctggttgtgaactcctgaccttaagtgatccactgtccacttggcctcccaaagtgctgggattacaggtgtgagccactgcatctggcctaccttttgaattttgaaccatctgaatgaatatcttttttttgagacagggtttccctgtgttgcccaggctggagtccagtggcatgaatatggctcactgcagcctcgacctcctgggctcaagcgatcctcctgcctcagcctcctatgtagctgggaccacaggcgtgagacaccatgcccagctaatttttaaatatttttgtagagacgaggtctcactttgttgcccaggctggtcttgaactcctgggctcaagtgatcctcccgcctcagcctcccaaagtgctgagatgacaggcatgagtcaccatgcccagctcaatacctgtttttttaaacatgaaaattcacacatatatgtaatggatacttccctgttgttgccttattggggaagcagtacacaggaggggttaaaagcatggatcttggcatcaaactgcttgaatttgaatgccacctctgatacttcttgtttgaccctggacaggtaagatggtttaaaatgatacctataaggttgttgcactgattcaacgagatgatcactgtaatgcagttagcacagggcccaataaatggttcattttacctcctacacatctctggaatccactcacttctcaccatctcctctgccacctcctctggctaaggcgaccatcattcctgccaattttagcatctccagtctcttccccctcccttctgttttcagcatagccgtcagaacatctatttaaaatgcaatgttaactatgtcactaccctactcaaatccctcccatggctccccactgcttataggaaaaatcccagagtttgggacctggcattcaaggttccacctgatctggcctcagtggcttctcccacctcatccctcaacagtctcccttcactctctgtgccctgcccatgacttgctgttctcacctaactccagcccaaccactttaagcctttgtttcaaggcctaatgtaactcaatcttctcagtcctagtctccaattctggcttccctcaaatttcagtcctggcttgattggcgcagattatacaaatgagacacccctgttctgggagctgggaagagttcctccccgactggtggtctcatcctgcaccactcccaatgctaccttcaattcctctggagtggggctgactcccactttggatgagacctgtcccgtgtttcaaccagttcagtttgccccgagagaaacccagagccggtgcctggcacatagtaaatgcctgataagccttcagtgagcgaatgtaaccccaaaggctgggtgaagagtaaagctggggcaagaagcagagaggacctctgggatctgtgtgggataagagtaggttactgttaggtggtctcaggaaagccaggtgggccctgagtgggttccccagggctgggagccctgacctttgctgtcacctatgttgtctactgatggatttaggttttcttttctttctcaggcagaaagtgggagatgggagacagagcgatctcaatttagccaccctaaaattcctgttgccgtcagaggacccctctgcctaagatgcatcacataccaggccgattccaacctccaggcctctcccctggcaggattcttctctgggtttccttgtcctttccttctcatccgtctacccttcctagtttgacctggctgagccctggtgaaatctctgcctctcttcctctctgggtccaagcacccctcacacccgctctctcccctttcctccatctctgtccagtgccctccccctcccccctcctccactctgcctccagctttttttggctgctgtctcttcctcctcctcctcctcctccctccttccctgacgctgaataatcaggcctggctgtcctggtttctggaaatacccgtgtgtgggcagtggctcagggctagaacaggggatggatggatgggggcccctgggcagccccagacccccagtgcaaagacaacaaaatccagggatgtggtccatgcctgcctcctgctggggaggggagggcaggaggtttattgagcagttggggaggggtgggaattcagagggcgtggacgcaggccatctcgtctcccaagtcctcctcatcgaagcgggagaggatggactcctcgtcgctatagagagagctggttccctgtgccagcaggtcactggcagcattgtccatctcatccagcgtcaggcgacacgcatctgcaatctcctgcttggccagggccacgaaacgtgggtctcgagcaaagaggcccagaccctctgagataagcacctgggggcacaggtgggatcagtgttgacggacggcacagtgtgcacagaaggttcagtgtggataaatgacgtgcccatgagggcatgtagggaagtcagtgggggacaggggtgagcagaggtcgtagggcaaagggatatctacatgcacaacacaggacctggggactcctttccgtcctcctccagtacccacctcctccccttctcccccatccgtcttgtctatatgccctctggactcacagcctccaccaagctgtcggcactgcccctcttcccatggctggggtccgagtgggttccaggcacgtgcagacaggtgaaggtgcgcagtgggccactggatctgccgaggtacccctcccccgctgcgccctcttccaccaacaacagcggggcatacaggagccgaccccgctgaggtggtgttgcccaggaaccctgagccagaataaacatcagaggggcagggatggatgagtagggtatgagggtctaggactcaccgctgtgcctacttctttccctcagtatacaactggagtgaaattgaatgggtataagtcaggcttgagtttatttatgtaagagtgcaggaggcctgggtttaaatgtcagctctgccacttactagctgcatgatctggggtaaacctctcaggacctcagtttcctcacaagtacagtgagcattgtgtgcattcattcatatgtgtcctgttcttcagaaggctctgaggccaggcgcggtggcttatgcctgtaatcccagcactttgggaggctgagacaggcggatcacctgaggtcaggggtttgagaccagcccggccaacatggtgaaaccccatctctactaaaaatgcaaaaattagccaggcatggtggtgagcacctgtaatcccagctacttgggaggctgaggcaggagaattgcttggacccgggaggcaggggttacagtgagccaagatctcaacactgtactccagcctgggcagcagagcaaaactctgtctcaaaaaaaaaaaaaaaaaaaaaaaaaaaagggcctgatatgtgctgtgtttgagaaattcagcctaggctgcccccatctctccagaccccagaccccagcaccacctccacagcctcacctgagccctattgggccctgaatttcgcccacgatgataggtgcctgggatgggtaaatcctcacaactgccctggcgctgcagacactggatggtgaaggagggcttccgacctgggggtgggtggggcaccaggggcaaatagcaatgtcagtgcttccccagatctctgtcctgcaggcccgtgggggccccttggatccatccctgctctcacctgcaggtgtggggggcagcagacggcggcgtggtaccaggtgcccatccatgtatctctgagctctgtgaggtggcaaaaggactgagcacgggggagtccctgcctgctcatctaggtaggaaagcctgtgtgggtgggagggccaggggtgaacttgggtctgggcctggacctgggcctgggagatggggcacaaacagtcctccccgacccagttcccacccctcctccaccccagctcatgggttcatcccatgtggcatggccagtgtaccgatcagggacttcctcatcctcatcttgcttgttttgccctttggttcccttgggctgagaatttccttcttctgggatggtgaaaatgagagccccagagcctctcctggggaaagggaggcacgttaggcagaccagatccctcaatatgtggccctggacccctggttcctctcatcccatgccccaacccttacagaaacactgggcttttggatttttttgttgaggacaagtcacataaaattaaccattaaccattttaaagtgaccatgggcttttgtttaatagatgttcatctaattaggactgaaagtttcaaaaaaatcaaagttgacctgtagagagacaccttgaacacaaaactgggcatgtattaggagtggggggagcctgtaaaagctaggcactttatttttttatttctattttttattttctgagacgaggtcttactctgtcacttaggctggagtgcagcagcatgatctcagctcactgcagcctcaacctcccaggctcaatttatcctcccacctcagcctcccaagtagctgggactacaggcatgcgccaccatgctcggctatttttttattttttgtatggacggggtctcattatgttgtgcaggctggtcttgtactcctgggctcaagcgatcctcccaccttggcctcccaaagtgctgggattacgagtgtgagccaccgtgcctaggcaagctagacactctgaaatttttttttaaaatttttctttaatctgcttatgtattgtctagcagctaagtgtttgacatgcattacctcatttcatcctttctttatccctgtgaagtaagtgctttgtcatcccccttaaacaggtgaggaaactgaggctcatagaaacgaagtgactaggcagggcacggtggctcaagcttgtaatcccagcactttgggaggctgaggtgggcagatcacctgaggtcaggagttcgaaaccagcctggccaacatggcaaaacctcgtctctactgaaaaaaaaaaaaaaaattagcctggcattatggcgcacgcctgtaatcccagctactcgggaggctcaggcaggagaatcgcttgaacccgggaggcagaggttgcagtgagccgaaattgtgccactgcactccagcctgggagacagagcgggactctgtctcaaaaaaaaaaaaaaaaaaaagtgattagctcaaggtcacttagcaaatggcagaggcagaatgtgaactgaaactcttggtttcacacaatgtgctttttgcattaaacctttgtattgcctttctcatatgaatctcttatcaccctctattcttacctgagcccttgaaacacctccattcttcccaaatttctgcttgaaggcctctaggccctccctcccacccccctcaacttcctgcctcctgaattgcctctatccagtgtctagtccttgccttccctcacaatctacttccagacacttgataatacctgtgggtgttggatccagcctggggcacactgggctgactggaggtgggagtccccctgtcatcatcactgggcccaaaggagagtgaatctggaagtctgtccccgacaggcagagacacagaaatcccggagccccggcgagctgagggctgggagaccatcgtggcctgtggagagtcacaggactgagtgttgcatgcactttgtggctaagtcatttggtcatataacatgtctcccccacaggtccatgaatgtgggccttgccctccaacagcaatggtaaatgtcaaataaataaatacgtaaataaataaataaatatttgcgatagggtcttgtcctgtcaccaggcgggagtgcagtggcatgatcacagctcactgtggcctcatcctcccaggttcaagcaatcctcctgcctcagcctcccaagtagctgggactacaggcttgcaccaccactcctagctaatttttaaatttttttgtagagaggcggtttcactattttgccaggactggtcttgaaccctagggttcaagcgatccttccaccctggactcccaaagtgctgggattataggcatgagccaccactcccagcctcaaataaatatttttctattgcagagggggcttctctgggggagcttcttcccagaagcagtgtcaaaatcactcaggggattgacgaagtattttacaatcaagttcctgggagagtgaaaacttgtccccactttgttagtttccaagtccttttcatcttcctcctccactccctcctgcccctcttcttcctcctcctctgtgtcacaggtgagggcctgccgcatctcaggacccaagtcctgcaggctccgcagaccagcctgtgggggtggagaaataggtaagcaggcagctcagggtctgaactttccctctgtttcccctgcaggcgggtagggtgggggaaggagtccttcagccaccctggccctccgtgaggcctggggcctcagtttccttatctgtgacatgggtttcacaagatcaaaatgggggtcagcctcagccacagcactgccacacgtgcccatccacactaggccctgccccgaagacctgaagggcggaagaggtgctaggggcggcgtcgttgcctagtagccctttttctttcctccgccggaatttgcggaaatagtcctggatcagaaatgtggcgtagaatttgcccacggtgacctcctcctctaggggcaagggagagaaggcaagatcacacaggggccctctgacccagcccacctcgccgcctctctacccaccagcatggacttcccctcgccctctgcccagcgctggttttgtggtggagagcgatcatctgccattcaggggctggcgcggggaactggggcggggatagctcaccgtctggtggggggatgacctcatctagcagcttctgtttcatccgcttccagatctttttgatgacaatccgcagctcctggttggcttgctccaggttccctgcgttggaggaggatgtggggcatgagccaataggaagaacctccacagctgccccctcactgttgggtggggggaacttcacaagctgctaccgcagatgcacaccgcccccattggacggggtggggggaaacaggcctggagaatcctgtcacccattctggggttcagagctaggagtggggcccatgattcaatgagtttgctccttgcaccctccccaggaacgatcccactcctgcccctcccctacaccttctgttttgatcttcagggatgtccggaccagggcaaagagtgtggcgttgaatgtcaccgtcccatctgagttgaggggcatgttcattgccacaagtctctgcaaacacgagagacatgaaacccactctgggaaaatgccgggtatgcaggaacgaatgtcaaggggcagaaacctctgaggatgcgatcaaacacccctccccacccaaggcagatcccttcccacccttgccatgtgatagacagttctctcaggagcctgggggtgggcaggtgcacagaccttgcaggccactcggtgtgggcacagcttcccaaatcccagagggggctggatacgtctcagcagggcaaccacatccaagtgtttgatgcggcccctggaggagttggggaggtaccactggattggcgatgcccccactagccctttctcaaggccccaccagctcatcactacctcctcctaccaataccccagagcttgccagggaagaactggagggcagtcagagagggcagaggatggggcagtggaaactttggggcatctattgactgggtaatgagatgcagcagtcggaggtttgggggctaggggactgtgtagggcaatacattgtcccctggattctaggtaagggtatagagggcatacttggccccagggtcatattcagaccagatcctcttgaattcatcaaggtgatgggggcccaggatggaccaatctctggtgagataatcaaagttgtccatgatcacagccacaaagagatttatgatctgtgggccagtgagcaagggagcagttaggtgaagggcagaacactgtcatggacggatggtgggaggctggggcgggcttatatggtcatgagtctctgggttgatcttgtcatcagaccagccctctcacccactatgaagatctgggctgcccacgtcacatccctgagcccctcagggccagcccccgtgacggtggtggtggttgtgaggaaatggttctcaccaggaaggcacagagcatgaagaagctgatgaaataggcgatggcaaaattgctaccacaggtaaactcttcaccagggccgaagtcagactcaggatcacaccgatttccgggaaggctggcaagcattatctcctgccatgcctcaccagtggcacacctggtgggagtcacacaggggtagcatcctgaaggggaggctatgaagtcatggtaaatggagttgggggaggactggggaatgaggagatgacctacttctcaccaggggctacatctggcacagataacatttcaatattttaacagccagtgtggccatgttgacgacagtcatgtttgcatcttacagatgaggcactgagacctgagaaggggaggcgtcttacagtcagaaagaaaatggctgaggctagaatactctaacagactcctcacatcatagccaggaaacatctcgggctgtatggagccccatgctgccatattattcccatagctcaagcagtctggggctcagagagggtgggtgggcacccacgggcataaggtggcaggggagtgagtagatgtcacctgaacagaagcagcacagcctgtggaaaggtctggaagttgttgtttcggtttatctgtgtgccatcctgaagagccaccttgccgaacatctgtggacacatcaaggctgtgtcagtggggtgaacccatgccccacccatttcacacctcctaatacctaaaggagcctcataaccctgacaaacagggcatcactgctgatctcatttcacagatgtgtagattgacccagggccgtccagcttgtctgtctacctgccacccctactttggggctattcttaacccatcccctgccagcagaggagtgcttaagggatgcttcctagggtccccacttgcctgcatgccaatgacggcatagatgaagaatatcattgcgatgagaagagccacatagggcaaggcctatagggatgggggaggggggcagagaatagatgcacaggctcaggcaaagaactataagccccagaatgcactgctttccctggcctgggcctactgggagatgcagtccatctccaaagtgccaaggactgtggtgtctctcaaatgtgaacatagtgttaagtagatagagtaaggtcagtgagaccagaggtgtgttggaaactgagagcccagaaaaaagagaaaattggaataataatttggaaatgggtatggcatgttgggagatgtagttctgagggtggtaaaggggcaggctgagaagtgtgaaatgggggcgaggtatggtcaaagggatggggtaggggattacctggaaggacttgatgaatgtccagagcaatgtgcggatcccttcacccttactgagaagcttgaccagccgcataactcggaagaggcgaaagaaggtaatggaaatgcgggagctgtcctcagagctctggggtgaggggtgcagtagggatgctcagtttgcatttactccagctatctccctatctcatgctttggccctcccagtacccaaatcactcaggccctagggtaatccggagggatggagggacagagggacatgggaaaagaagcagagagtccctgttattagggtgggctacctcgccaaggtggccaccattctggagggagatatggccaagaaaaaggtgatacaggagatgatgacatcataggcccaaatgaacaaggtgagatatgatggagcagatatagggggtgatggtggggtcattacacaggggacaatgggaaagtttatatggtagtggattaggattaggaaaaagtgggtaatgggaatggaagggagaggagagagtaaaggaggtgatggatcagagacattggagccaatagaggaaatgatggaaccagtggtgtcatagagatgatggagatgagagaaccgatggagaagccaatggagaagccagtgatggagatagggaaccagcagcgttgtcagttgaggtgacagaaccatgtagtacccaatggaggtgatggagccaatgatatagtcaatggtgatgacagagccatgaaagagccagtgtcagagatgatgaagttggtggagaaatgaagccaatgaagtcatcagaaaagatggagccaaagcaggagccagtgaacatgacggagccaatggatgggggatgtagaggcaatgaaagagataacagaaataacaggagaggcatttcaggagatggtggagccagtagataggttacaaaatggaatgagaaagccagtagagggggacttttgctgaacccaacagggactcagaagagatagagctagaatgaggactgagtctccaggagtagggaggatgtgcgtgggagccacccacccacgtgaaagggaaccccgggatagaggtgagggaaggtgtatagggcgagagtggattagtggaaaggccagttctcacattgacttcagtgacggcaatatccactatgctgcccaccacaataagagcgtcaaacgtgttccaggcatcagtgaagtaatgctgcaagtaggagaaaagcagtgccctgtcttctcaaagctcgcaagccagggtagggggccagtagtagtagggggcgccggaggggggcagggcttcgcttggatcacacgatgggcctgcacctgagtccctctcactccctagactcacactccctggctgctgcccgcatcgccaaccccagagctctgcaatgagctccactcccaaggaattcatccactggtgggtggggctagagaaggggggccaccttgggcttgaaggcgatgattttgagcaccatctcaatagtgaagaggccagtgaagaccatgttgaggatgtccatggcatagttgaagggagcagtctgctcatagtgctgcaggagaaaatcaggttgagatggagcctgaggcagagatgccgccacacccaaccaaatattccctggcctgggctgaggcgagtctggggacttgattgcactgtgtattggtcaaacctcttgcactgtctgcctcccattatggatactggaaagtttagttcttgattactagcttttcttgtagttaggcaaggccaggttgactagtgagacataaacataaatctgctgttggttagcagcttgtgtaaaaaaaattttgctttccgatgaaaggatcaaataaggagaggccccaggtgcagctctccctgccttgagtgtggttttgatgcctggagctgtgatcatgaaacaacaatcatgaaaatgaatgccaacttgctaagaatggtgaagcagaaagatagagcatgggtcccggatgaacaatgaacaaacagcctacctctgcacttctcaatacatgaggtaattaccacagttcattgactccaggaggcacatctttttacattttagaatctctgaaattggggcgcattttataacaaatggcaacttacaatggccactggctacttttttttttttttccacattcttacatctccgaaatcagaatgcaacttacaagtactggccatagacttaaagaaatgtggcaaatgtctttatagcttaagttgctgttagttggcagggggtttgttatttgcagccttaaatgttcccaatggttcccaagggattatgtggagataatagggtcaggagtctggcgggggtcaggcagggatctcagacctgcatggctagggcaactgtgttgagcaggatgagcaggaacatcaggtactcaaaggcagcagagttcacagtggcccacacacgatactgatgcgggttcttggggatgtaacggcggagtggctgggccttgagggcatattccacacattgacgctgcataccagggcagggcatgagtgagcagtggggtcctgaggcaaggagggaagggttggtgaccatccatagggggtcaggggtcagaggtcacctggttcttgtccagctcacagttttggtactcctgctcgccctgggcacggaaagtgatgatgacgaagcccacgaagatgttcatcatgaagaacgcaatgatgatgatgtagacaatgaagaacactgagatctccacacggtaattatagatggggccatggtcctctgcatatgcatcgatggccttgtatagcagtctgtgggagccagagggggggtagaggtgggggcaggtgaggggatatcccagccccctcagacctgcccccagtctacttatcacagacaccccagagtttcctgcctggcaccccaaagacccctaaatctcctgacctaaccacctgggacctccatacatactctaagagacctctaccaggccctcaaagagtccaaatcctctgtcccatgccctcagaaacccccatagagtcctccagagaatctccattcagaacctcaaagacccagaaatcccctaagtttccacagaccttcaaatccccttctccaaccacttggagacccccatgcgcctccccagaacttccacacaagcccccaacgatctgtaaatttatccctgtcccatcaacttgaatccccactccatctccccacagagccccacaatgagtatcccaaagacctgcacagctttctagaaatcgctgaatccctgcttcatctcttcagagaccaatcccagtcccctcagacctccactctgtccccccaaaccatctccaatcctttccaggcttctatctagctacctagtcccttagaaaccgctgtccaattcctggagacccctcactcaagtccccaaagaacccccacccagcttctgggaactccacctctacagtcctctgatacacccaccactctccagaaaaccctatccagtctcgagagaccttcgtcacatccccaaggtacactcccacccattcccaggagatcccaacccaatcctgcagagacccctgcctcatcccctgataaacccagggccctgtccctcacgcaggccagccttcaaaggtggagacagtgaacagggccatcatggctgaaaggacattgtcaaagttgaaatcactgttgacccagagccgctcccggaccaggggccgtgacacgtctccatctgggtataccaggaaggagcccctgtggatgtgcaaacaggttagatgggtgaggaggggtgaggaactggggaaagggtctggggtctccagcatggaggcagcaggacatagtggtggagcaatatgttctaggttcaaatcctgtccctccatgtcctggctgggtgaccttgcgcatttaccctttctgtgcttctgtttccccattctaagaaataaggataataacagaatcgatttcctggcttgtcacaaggattaataaatgtcacaagtcaataaatgagactagtgtctggcacatagttggcatcatttcatcatcaccattatcatcctcatcatcgcccaccaggaaaaagtaaaacgaataatagccaacgtttattagcagtaactatatgccaggcactgagctagattttctttttcttctcttcttttctattctctctttttttttgagacggagtcttgaaaaagactctgcccaggctggagtgcagtggcatgatcttggctcactgcaacctccgcctcccgggttcaagcgattctccctcctcatcttccagagtagctgggattacaggtgcacaacaccaagcccagctaatttttgtatttttagtggagacggggtttcaccatgctgactaggctggtgtcgaactcccaacctcaggtgatctgcctgccttggcctcccaaagtgctgggattacaggcgtgagccacagcgcccggcccaagctaggttttctgtgtagcaactttacattgtacaaagtacattttccatgtagtagctcatttactcttcacaacagccttgtgagataggcactgtttagccccgtttttcagttgagtgaaatggaactgagtaagtttaagaaatgtacctaagtctcatgaagtggatttgaaccgtaatgtctgacttcacagcccaggcttttagctactaccctctacaggagtctcaagatggaagctgggggctcagggtgggaatggtgattgctaatgggtctggagtggaatgtaggtcacttggggaatgcggagagggatttgggggaggtatcgggggccgccgaagacttggtgagatctgagggcctctgcagttcttgggacaattctgggactatatctttgggccttggtgagatctagaggctctaaagtctttgggaggggtcctgagctccgtggacggcagggtcttgggcactcacttgcattcttgaggggtgtgtttggcctcgtccgtgcaggtgtagaatttcccctgtagagaggatgtctgtcaagtaggttcacccttcatcacactcccgcccagacccctgcctggcattccctccagtgtttgccccaccttgaagagctgcaccccgatgcaggcgaacataaattgcagaagtgtggtgacaatcatgatgtttccgatggtccggatggccacaaatacacactgcaccacatgctgcgggcacccaagcatatggctactgaacactacaggccacagtggtcatggggcagggactctggtcatagatgcagctgagggacttgggctggggacatgtggtgatgggtcagggatgtatggttagcaacatgtgttcaagaggcagtgttatgggctagagacgtgtgggcatccaccaggaataagtgtttgccgggtggggatctgtggccacctgtcagggagctgggtctgagaaatgtggccactggtagaaacatatggtcacttggaaggaacatgggtcaggccacatggctagtggtcagagatgtgtatttatgtgtcgggtccaggccgtatggtcatgcatccgtgcaaatggtcagtttgatcagtgatcctggccccaggggcagggcagggcctgggtcctgtgggtttgggtggggtggggttaccttgagtcccttggccctgttgatggctcggaggggccgcagtactcggagtactcgcagaatcttcaccaccgagatggcgctggagctggggaaggggcaatcctcaggcattggccctggctgggccctggctgtgagaggaatggggtgggctggggatctgtcacttactggatgccaaaggagatgagggacacactgaccaccagcagatccaacatattaaaccagctacggcagaaggagccgcggtgcaggaaggccccaaacactgtcatctggggacaggacaagaggctagactcagacctggggatggtgggggttgggggaggtggggatggggacaggagaggtgggctgcaagaaccggtggggagagtgccagggcaactgagggtaggactggggtcccattagtcacctttagtagaatctccacagtgaaaatggaggtgaaggcataatcgaagtaacccagaatctggggtgtgagaaagagcggggagccactgagtcacggctgagggggatcctaggtgacttctcaaaaggcttggccatcagaaagattagggttcaaatttggacccttctgcctctacccagctacatgggcgcctttggcctgcttaacctctctgagcacagcttcctcctcagtcaaatattgatctcctccctggtgcttccccgtgtgttgcacatgccgtaaaggctggcattgcatcagctgcgttaatgagcccctctctcggctcacctagggctcttctccttatctccaccctgacccagcttgtgcccactaggacacccctgggagtgtcccctcagctcctagctcccagccaaaggctcacatggttgcggaaggagtgggctcggatggggtcctcagcggccagggacacactgctgaggatgatgaacaccaggataagattggtgaagacatgatggtggatgagggtgtggcagcccttcctcagcctgtggagagggagtgggccatggtcagaactcaggaccacagaattgttcagggattccaagggatacagttctggccctgacacaacacccatgcccccactcccaccttggctgctcctccatgctcctccacctgccctagcccctcctgcctcaccccctgccacttccggcactcacgggttggtttggctgaggcagaagaaggcgctgccctcagggatgggtaccaccttctccttgggtacaacttcctgcaggagttccacaccccctgcaccctcttcctcttcttcctcttcttcctcttcttcctcctcctcctcctcctccatgtctggcaccagagaaaagcaaaaaaaaattaattgagcaagttgatgtaaagcacccagaacagtgtttgccacgtggtcaattcttcccatttccctgctagaatgtcagctcctccaggaaggtattttagtctgttttgtatgctgctatgtccacagcacttagaacagtgcctgggacacagtaggagctcagtaaatgtgtgttgaaagaatgttgtatatacagactattttataataaaggctctgagaagttcagcagtaaacaaaacgtgtttctcttcttcttgtttttctttaaagatagggtcttactctgctcccccaggctggacttcagtggtgccatcatggctcactgcaaccttgaacttctgggctcaagcaatcctcctaccttagcctcctgagtagctgggactacaggcttgcatcatcatgcttggctaattaatttcttttttagagatggggtcttgctatgttgcccaggctgcatttcccttctttaacctcaatgttcccaaatgttgctgaccacataccaagtctgttattttcaggatgatcttggaaaaggctgatctctggagaggagggtctcaggggtcaggagctgtctgcctgagctctttccccaaggtcccacacctgctccacctggccctgcccacttgcctgctccttccctccttgcaccctcctcttcctctttctccacaccaggcacctgaggacaggaagacgggagtcatcaatggtgagggagacacagggaatggacacaggggaggcatggaagaaatgtaataataggggaaagaataggcagaggatgaaggttaaagacatgcacatatggctgggcgcagtggctcatgcctgtaatcccagcactttgggaggctgaggcaggtggatcacttgaggtcaggagttcgagaccagcctggccaacatggtgaaaccctgtctctttcaaaaataacaaaaattagccgagtgtggtggcgcatgcctgtaaatcccagctacttgggaggctgaggcaggagaatctcttggacccaggaggcagaggttgcagtgagccgagatggcacaactgcactccagcctgggcgacagagtgagactctatctcaaaataaaacaacaacaacaaaaaaacagatatgcacacatagacaggtagtggtgggagtgggaggtgtagacagtgcccaggcatctaactcaccaggccttcattctcctgtgggagatccttctcattgctcttctccctgtgcgaggaaataggggtgattgctgcagatgggctaagggggatcactacagtcagaacagacctttcttgggtcccatagaactttcttgcttccgctcttccccactgcccctcccaacagtccgttctcaaagcagccagagggagcctgttaaaccctgtctgggatatcccaactctgcccacaaccctcccatgtctccttaattcaggaaaaactacagtcctcaccctggcccagaatgccctcaatctggccctccatttcctccactgaccttcactccataccactctcctccttcctcactccattccagcctcactgtttttatttttttgagacggagtctcactctattgctcaggctagagggcagtggtgcgatattggctcactgcaacctccgcctcctgggttcaagcgagcttgtccagctaattttcttttgtatttttagtagagacagggtttcaccatattggccaggctggcctcgaactcctaagctcaggtgatccaccctcctcggcctcccaaagtgctgggattacaggcgtgagccactgctcccgggcatcgctggtattttttgaaagtgctaagaatgtggtcaggtgcggtggctcacgcctgtaatctcagcactttgggaggctgaggcgggtggatcacctgaggttaggagttcaagaccagccttgccaacatggtgaaaccccatctctactaaaaatacaaaaaaatttagctgagcatggtggtgtacgtctgtaatcccagctactcaggaggttgaggcaggagaattgcttgaacctgggtggcggaggttgcagtgagctgagatagcaccactgcactccagcctggatgacaagagtgaaactccatatcagaataaaaaaaaaaagtgctaagaacattagcgccccagaagctttgcacttgccactccccttccttgaatactcttcccccagatatttgcatggctcactccctcacttcattcaggtctctggtgaaatgtcacttcctcacagagaccttccttgctgaccttaaccccaaagagcaatcttcatttcttgctatcctttcattctgttttctctttattacatattattaacatatattatatattcatttgttttatttttcttgccttcctcaactagaatgttagttccatgaaggcaaggactcttgtctgccttgacccctgttgtctcctcagcatctagaacaggacctggcacacagtaggcagtcaatagatgcatgttgaatgaatgaggactggcagatggtatctggagatggggattaccagggtgactagaggcatctctggtggtgggggtgtctgaggggttcccagtcagggatcccagagagagactgtgttaggggtggagccagatctcacccgcccttgtccttggcagtgcctgcatctccactggccaggttgtccacagcaatggcaagaaacacgttcaacaggatgtctgggatgagcttaggctgcaaaggatggagaagcaccctgcctatagaccacccagttccccttacccaccccgactccaccatcatccagccccacaaagctccaaggatacagttgccacagatgaagagaatgatgaaatagatgcacaccaacattcctgggaagaaggggccaccatatgccatgataccatcatacatgaccacgttccagtcctcacctgtcaggatctgggggtgggaagtcactgtggagctcttggaccccctccaactccagggtctccccgacccacccatcccatggtctccagatcctacctgaaagacagtgaggagggcctgggggaacgtgtcaaaggtgcttcgcttggtgtgggtctggtcaaagttgaacttgcccccaaacagctgcatgccaagcagggagaagataatgatgaagaggaagaggagaagcagcaaggatgcgatggatttcattgaattgagcagggatgccaccagattgctcagagaagcccagtgtctgcagcagaaatgggagggggcagggtcgatgccatgtccactggacatggctggagcatcaggagccagggcagggctccagcttgagatgcacctcggcaggttgggctcaaataggctttggtgtcagggttagaaatgattttggagttggggtgagatgagagtaagaagtgggggaagctgggccctgtggtggctcacgcctgtaatcccagcactttgggaggccaaggcgtgtgggtcatgaggtcaggagactgagaccatcctggctaacacggtgaaaccccgtctctactaaaaaaaaattagccaggcatggtggcaggtgcctgtagtcccagctactcaggaggctgaggcagaagaatggcgtgaacccaggaggcggagcttgcagtgagccaggattgcactgcactccagcctgggcgatagacagagactctgtctcaaaaaaaaaaaaaaaaaaaaaaaaaaaaagaagaagaagtaaagaggtaggggaaagttgagagtttggggttagggttggtggtaggggtataatgggagactgggagatgaggttaggatggagtttttttttttcttatcttttttttttttttgagatgaagtctcactgtgttgcccaagctggagtgcagtggcacaatctcgtctcactgcaacctccaccttccaggttcaagcgattctcctgcctcagcctcccgagtagctgggactacagtcacttgccaccactcccggctaatttttttgtatttttagtagagacggggtttcactacattggccaggctggtcttgaactcctgaccttgtgatccacccgcctcagcctcccaaagtgctgggattacaggcgtgagccaccgcgtccagcctaggatggaggtttaatggaagttggtgaagctagaattgggtttcagcttgggactgggcctggtgttggggatggggttgtgatgtatttggggttggagatggagttaagggtaagttgtggttgagggctgggatagaggaggggatgggatgagactggggctgaggctggaaatggagttgcagttgaagatagggtgatggttaagggttagggacgtgggagttctctttggggattgaggatggtattatggttggtggttagtgacagggatggggctgggagttagggatgaggtgggagatggagttgggcttgggaatgggtgttagcgttgtaaatgggctcataggtgacctgtggttgggggttgggatcagagatggtattgtggttgggggttgggatggggtttgggctgggaatagtatggcattgaaatcggagacagggttggggaaaaacgttagagcaggagttgaggttgaggaaggcaatggaaatggagtagacattctccccagtggatgaagacaggaacttgtgtctgctttgattcctggtgtttccctagggcttggtagggtgcctggcacacagcaggcactcaatggatgtctgctcaatgaatggtgaagcagatgaagttatcattggagcttgggtgggggtgttgaggctgtgtttgaggcccttgtcttccccctcccctaatacaaacctggtgaccttaaagatcctgaggaggcgcacacatcggagcactgagatgcccaagggctgcatggcgcccacctccaccaaggtggtctctaggatgcccccacagaccacaaagcagtcaaagcggttgaagaaggaagacacataggcagaggggcccagaccgtacaatttgagaagcatctccaccgtgaacagacagagcaacactttgttggcatactctgtggggagagaggcagggatgatcgggctggccagtttctgtggtgacatgtggggaggtaactagggaccatggggtgacccacggtagctggtatcaggccaggtgctggctgagggaaggcttagggctagggattggggtgagtttgtaggtcagagtaggtgaagttttgaggggcttggagatggggatgaggggcagagtcggggtgggggccagagtcagtgtctatgagtccagaagacccaaattcacaagtagagttagagtctagggtttcttcgggactggggctggtttgtgggttatgggttagaaatgtgctcggtattcaggctggggctgagattataatgaataatagtaagagctgacacttataaagtgttagctatatggtgggccatacaatgtcctaagcacttttcactttacatcatttactcctcttcgctgcttcatgaagtggatactactatctatcatctccattttgtagatgtggagaacttttccagacagtgtgatgataagagcctggattctggagccaggctgcctgggttctaattctggctctgccactcgctagctgggtcccgagattagtcgcttaacccctcagtgccttgatgctcagtgttctgtgccttagtatttaattcgcataaggttgtggtgaagaaattgtcagtacacataaagaaaggtgctgagaaaggagcttgaggcacacagcaagtgctacctgtgtaagctacaaggtgggatgggacaggctaagggctctggatttatttgggtaggggggaaggcagtgtcttgggggctgaggcgccctagaggttttggatttaagcttctggggtagaaggaataggaggctgggggagacgactagcaggctgggggtgtaccctggatctgggtgagccacacaggctgcccgtggtgctcagaggcgatggtcaacgtgttgaggaagacgagcaacagcacagcccagtagcaggcattggacttcactgcccgacggcagcgtgcccgaaggacccggttggctcggcggaggcggcggctgggggaaggggagcccacaggctgagatcacctacctaagcctgccctggggggctcaggtgggggatccaaaggtcatgagggcttggaggtggggggtttcaaagttatggagtcaaggatttgcacaactttcccaactcaccagactctggttttcatgatcttgtttctgaaaaagaagggggatgggaggtgtgtgtcgtaaagggcagaaggggtgtcagtgactggggccagaggtcaaggactgagatcgaggcttgaggctaaagaaaggacttgagtcagggtttggactggcttctgggctgggtcaggggctgggggccctcacaggcagcgtgtacagctggccagagccccctcctcctcatcctcatcgccttgggtctctgtcatggaaccggtgtcactggctgggaggctggctgtaggcaaggtggggatagtggtcaggacctgaagaccccgaggtccaatctttggctttcacctctgcctacccacccccaccccagcctggctggacccccaccatggctgctggtggagtgtgtggagcgagtagaatgactgaaccagcgcagacgtccacgcctcctattggtcagctcggccagctgtggccctgcagggagagaaaggacaattagggaggacatactgggggcagggttagggccatgtctagggtaggggtgtcatttggagtctttatagctgaggctggtcttgattctgcattttgagccataacttgggggctggggctagagttgttgcagatcaggcctgggtgggtctcaggagggcagaccacatctaaggcatgcagggaatgggccagattggagttgcctacgatggcccgcccggccctcttcagccatagaaccaaggttgtcatcggcggaggggtcctccatgtccagctcttcggcttgagtgatccagtccaggtagccccgcaggtcttcctccatctgctgcttctcccgctgcttctggaagtccccgcgagctttcgctttctctctctccttggagaactccctgagggaggaggatagagggctagggggaggagccaatctgaacaccttgctttcatcactccagccacactagcctcctagctactctttgaatatgccaagcacattctagcctcagggcctttgcactgaccattctctttgcttggaatgcttttccctcagataaccacatggtgcacccacctcatctctttttttttcttttccccagatacagggtctcactctatcactcagggtggagtgcagtggtgtgatcatagctcaccgcagcctcgacctcctgggctcaagcgatccttccacctcagcttcctgagtagctaggactacaggtgtgcgccaccatgcccagctatttttgttcattttttgtaaagatgaagtctcactatgttgcccaggctggtctcgaactcctgacctcaagccatcctcctgccttggcctcccatagtgctgggattacaggcatgagccactgcacctggcctctttcacatttttactcaaataacaccttgtcaagacagcctttcctgacatccctatttataatcacaagatctctccattcttatcttttatctttcctttctttccacagtacatattccatataaaacactatatatatgtgtgtgccaatatataaatgcacacacttattttattgcatatgttgctactttctgtctctccccatcagaatgtaaaaccaggaaggcagagatttttgtcttttgttccactcctaaaatggtgcctcacatacaatagatgctcatgattgaatgaaggagtatttcagatgggttttgaaggatgtctaggagtttgccaggcacaaagaagtgggcagtggctgaggggtgggaagcagggagtgtctaggtccctcacccactcaggacgccaagcacaaggttgaggacgaagaaggacccaaagatgacaaggctcacaaagtacacccagggcagttcataccccatggcatcttgcatctggggagagaaaaggcatgcatccctcagggtaggcagacactcctgcgtgagtgtcagggaggaaaggcaggtgcagcctttgagctctgtgcccacagtccacctcacccagtagagcacatcggtccagccttccatggtgacacactggaagactgtcagcatggcgaagaagaagttgtcaaagttggtgatgcctccattgggccctggccagcgcccgcggcactcagtctggttcagcgtgcacgcacgccctgatcccgaagacgcacagggcgatgggtcctcctccgcttccatgtctgcaggaagactggagcttggggcttcgaagcaggcccactctcagtcgctgccaccctgaagccccgcccacttaggaagctcgacttgggtcctagatttttctctttctctctttctttctttctttttttgagacggggtctccctctgtcgcccaggctggagtgcagtggcacgatctcggctcaccacaacttccgcctcccgggttcaagcaattctcctgcctcagcctcctgagtagctgggattaccggcgtgtgccacaacgcccggctaattttttttgtatttttagtagagacgggggtttcaccatattggtcaggttggtctcgaactcctgaccttgtgatccgcccgcctcggcctcccaaagtgctgggattacaggcgtgagccaccgtgcccggccagtcctagatttttctaaggcaacacttagctccacttctagggcagaaccctgcgagctccgtattctgaaccactgggaagctagggatcccaccaaccgggatttaaatcctggcgtggagtcttgtaaataacaatgaggcaagagcctgggggcggagtcttgtgaatttggacgcgtctcttgaaaataggggaggggcaaggcatgggcgggagtctgggtaaatggtctgagtgtatgagaacagtcgtggagaataaagcttttttttggtttgtttttgttttgtttttgagaccgagtctcactctgtcgcccaggctggagcgcagtgagtggtgcgatccgatctcagctcactgcaacctccatctcccaggctcaagtgattctcatgccgcagcctcccgagtagctgggattacagacatgcaccaccacgcccggctcaactttgtatttttagtagagatggggtttcactatgttggccaggctggtctcgaactcctgacctcaagtgatccatctgcctcggcctcccaaagtgctgggattacaggcgtgaaccacggcgcccagccgaggataaagttttttaaaattgtttttgttattattttttggagactggatctcactattttgcacaggctggtagcaaactcctgggcgtaagtgatcctcccgcctcggcctcccaaatgccgggaatacaggtgtaagccaaggcgcagagtttttgttttgttttgttttgtttttgagacggagtctcgctctgtcgcccaggctggagtgcagtggcgcatctcggctcactgcaagctccgcctcctgggttcacgccattctcctgcctcagcctcaggttcacgccattctcctgcctcagcctcccgagtagctgggactacaggcgcccgccaccatgcccagctaattttttgtatttttttagtagaggcagggtttcaccgtgttagccaggatggtctcgatctcctgacctcgtgatccgcccgcctcggcctcccaaagtgctgggattacaggcgcagagtcttgtcttaagtgcggggcacttgcacttaagtcttaagtgcggggcaggaccttagcctgtgggtacagtctcgtgatggggcggagctattagcgaggtggggttgtagtctgatttagggcagagtcttgaatatatgggtgggacttggttatctggggatggaacctgagcctgggggccgaatcttgtgcatttcagtgggtttccctgagtgcagcattggatctaggaaccgaaggagggggcatgttctgcctaggaggggcgggcagactaaccggatcccaggaagtagcacgtcttgtgcattcgtccaaggaacagctcgagcccaatgatggcataaatgatgatgacgaagagcacgagcagtgcaatgtgcagcagcggcaccagagccttcatgatggaattgagcactatgtgcaggcctgcggggagggagggggaggcagaaataagggcggggtcagctcagccccacccccaccctccacctccgacctcgggggatgtgccactcactcgggaccccagacaccagcctcagtggccgcagcacccgaaacgccctcaatgccttcacatcgaagcctcctggctttcccccggtgtgcggggcgtcgcctggccgtccggggccctgctccagcagaacgctgaacagcctgatgggggagcaccgggcagggaggcggaggtcaggccttgggattcccccctccaccctaaccttctcagaaaagcacaagtccctgtaactagaaatagaaatgggttttaataatattcctgattctggctgccgaatgggggcggtctgaaagagtcgctttcctgagcccagaattcagcgggcctgacggtaggaaggcgactagggtggggtgcctcccgcagacgcgcacccgaccacgacgatgatgaagtcgagtaggttccagccattgcggatgtaggcgctggggtggagcaccagcccgtaggccacgatcttgagcaccgtctccacagtgaaaatcaccaggaatacgtactccacctgctcctgggggtgggaccggggggcgggtcgggaagtcggggagttatttgaaggcgaggtttgacgggggcgtggggagcatagtcaggaccgagggtggggctgagccaggcagggccatccgggtcagagagggggcggggtctggctggaaggagtgagctctactggggctctatttggctgggaactggctggggcggggcgggccttaccaggttgtggttggcagtgttggagtcgtcctcagggaaggggatgtaaactcccagggccacgcagttggcaaagatggtcagcaggatgaggatgtcgaagggcctcaggtggacacagtcaaggaccctggcagagtggcattggaacccccctactcccttgggaacctcccacccagtgctgacccttgacgcccaaggtgacaggtcctggcattctcgacccctgccctgacaaggccttgactttgtccctcctggaaaccttaaccatccccaactcttgctgtgattcagtccttgactcttgaaccctggtgacctttgcctttctgaacctgccccccaacccagttcttgactcttgaccttgatgatctcagccctcctctgttccagccctgacccaattctttactcctggtaccctgatgacccttacccctgggccctgcccctgccttccaggatgcttccactccacgatgctgatgcaggaccgtcgcagaggattggccagggtgaggcagaagagtgcccgaggtgaccgctgggcactggccactgccactgtcttgtgcttgctgtgctggtttcttcgcttaggggtccctaggcctgatgccccactgctttcaccttccacagctgggggcccggggcacagcccccattcgggaccagggcctgccccattggctggactgggctctggggtggtgtctatatggagaaactgtgtcagggagggacagggtattggggcaattgtggctgcttcctacctgatcctgtccctctgtttgaaggaaggagagaagagcatggaaaattagggagaactgggagtagctgggttaaggactgggaagtaagagtgttcgaattaagattagagtgagagtttataggggagtgaaggtgagattacatttccaagtgaagtagggtttggtgtttaagttgggggtagagtttaaattgccatggggtgggcgaatttaaggttaaatttgagtggtgggttttgggttagggtggggatgggtttagacataggtaggagtggagttttgtctaagggttaggactgggtattttgaattggaattagaattaggatacaggttagggtcgaagttgagttttgagtgggacttgaattttgcattggggttttcagctaaggccactcccagttcccatggtctcgtttcagcctcagagggcggtagattggcctggttaagattcccagctttggatgaaacaagctgcctgagtttaaatcctgactttaccacttggtagctatgtgttgccttgggcaaattatgtaatctctttgagcctcagtttccttatctgtataataaggatgataataacagtacctaaaatatagcggtgttatgaggattaaatgagttcagaatcaaaagaatgcctggcacatagagttattcccattttgcagatgagaaaattgagaagaaaaagttaagtgacttgctgaagtggctgaatggggagtcacactcagtctaactctagagccctcatggcttactaccaccatcaagtatgtcttctctctctttctctcttttgtttttgtttttttttttaaagggtctgtgcactttctggaaagtcagagactgcaatcactaacagtattgacatcccggggttgaggttgaggttaggtcactttaggtctgtatctggggtggggtttagactctaacaggggtttgccttctggctggtagagtttgtgttaggtttcaggtgggcgtttggataggggtcagagccaggattgaggttgggtttcctttgggaactaaggctgtggatgaggctgagaggccatggggggtggtgtctgggtcaggctgagcgttagggctctggtggcagagaggctgtttggggctggctgggatggggaacagggtgatgtggttcttgtcccctagaggctctctgggggtggggtctgggtgggcaatgggtgggtcagaggggctctaccttgctccaagggtctgcagggatggaaggattctctcacctttcccgccttcagattccgacatctttctttcgagattgaagggccatctgcacacaacccccctctcttcccccagctttggagggattaaggccgcagggcggggcaataacagtgttgtatgggagggtggcggtgggggtgcaaatgggacgtttgtgggccagagcctggcaacagatgaaatatttaccaaatatatacctgcagcaaacagtcaaactaaaataagaaaaacgatgtcattttccagtagtatatggaattcgaagtatataggaaaaacctaatatatgtgcaatatctctatggaaaaaagatcaaatattatcaattattattatttttagagacagggtcttgctctgtcacccaggctggagtgcagtggcgtgatcatagctcacagtagcgttgaattcctgtgctcaagtgatcctctgacctcagcctctgtagctgggactgcaggtgtgcactaccatgcccaactattttttttttaaattttgggttgcttcgaactttatttgagaacaacagaagataaacctatcaaaagaacacacaggtgggtgcgggggcacggctagtggcggcggccgggggcatccgggctaaggcttttacttggctgcagactggtcggatttcgcagctcctaggcccccaagctgggcccgtgactccaaggtgatctcgttggactgcgtggctagcttgggcatgggggcctccacggtcagtgtgccctcaggggacagggaggaggagaccttggtggggtccacaccggggggcagcgtgtatttccgggtgaagcatcgggagatgtagccatgctcgtcctgccgctcctcgtgcttgctggtgatctccaccatgccatccttggtcttgaccgtcagctcgtcggaggcgaagtagttgatgtccagggatacgcgccagcggtccgctgtgggccgattctccgagaccccgccgctgagctgccggctgagcgcgtagctgtaggcgggcgcggccaccgcggggctctcgaccgcggcgggggcaggggacgcacgtagcggggccagcagctggtgcccaaccactgcgaccagcccgaaggcctggtcaaagaggcgactgtgcgggtaccagtcgcggaaggggtcccagctggggtcccgcaggagcgagaaggggacgcggcgctcggtcatgctggctggctctgctggggacgtctgcttggacaagtgtcaatttttttttttttttttaagagatggtgtattgctgtattgcccatgccggtctcaaactcctgacctcaagcgatcctcccgccttggcctccaaaactgctgggattgcaggtgcgcgtcggctgttcaagaaatggttacatagatttcttttgctttatttatttatttagagacggagtctcgctctgttgcccaggctggagtgtaatggcgcaatctcagctcactgccaccttcgcttccccagttcaagtgattctcctgcctaagcctcccgagtagctgggactacaggcatgtgccaccatgcctggctaatttttctcattttagtagagagggggtttcaccatgttggccaggctggtctcgaactcctgacctcaggtgatccacccgactcggcctcccaaagtgctgggattacaggcgtgagccactgcacccagccggttacatagatatttgctgtgtaattattctttggagtgtacaaatgtgtatcatattaaagcatttattgaatgcatggacactagtaactataacttacatagtgctttcttatcttatgtgtcaggcacatagtacaacgtgctttatataaattaattctgttttaatcctaaaaagcaggtactgtcaatagtcccattttacagatgaggagactaagacacagggaagtagtcgctttgtgttaaaattctgcccttaatgtgtacacttttatagcctagaagatgaatgccgccttaaacgaatgagtcaggaagcccctttctgtccggcccctccactccccaccacacgggttgttcctttttcccttggaagagcccactggactgcaggtggaagaactacagttcccagcagctattgcaagctcaacctccgtgcacactcaccccaggcctcacatccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacgtaaggacagagcccccgcccacccccgaagcccacatccgggactctaaagcccaggaccccgtttcccgggaaccttaaaacccgggatcctgacattcagggctccaactccaggatcctaagaccctcacccccttacacacacacacacacacacacacacacacacgcacacacacacacgcacacacacaccgccctccctgacaccgacatcagaggcctcccaaatcctttaaccatgatatttggtacacccaaagctctgggacccagacaccttgagacgttacaaccttgaaacctcaagacccggaaccctgtaatctggggaatcttaacatcagttccctgagaccctgttatctggagaccctaagacacctgtgccctaagaaccagggagcgtaaaaccccaggaccctggcactcggggactccaaaaaatccctggaccagatacttgggatccttcaaactccagttccccaaacacctggggcttaaaaaaacccaggattctttttttttttttccttttccgagatggagtctcgctctgtcgcctaggctggagtgcagtggggtgatctcagctcactgcagcctccgcctcccaggttcaagtgattctcctgcctcagcctcccaagtagctggtattacagccgtgcgccaccttgcccggctaatttttgtatttttagcagagacagggtttcaccatgttggtcaggctggtctccaactcctgacctcaagtgatctgcccgcctccgcctcccaaagtgctgggattacaggtgtgagccaccacgcccagccaaaaaaacccagaattctaaaatctgacatcagcatttggtcaccctgacgcacgaagactcctccgttcagaggccctaaaaacccaggatgccaacatctagggagtctgatttttgtattgcttgaaactaggtggtcttgatattcagggatcttgatacccagggaccctgacatttggaacttctgaaaacagcagcctcctaaaatctagtcttctcaaaactctagcagctcaatatgtatgcaaagaacatactatctgggaaccaagaaacccagagattgtgccacctggaccctttcaccttcccagactcccaaattttgatatttttctaaactgagttctcttccacccaccattctcctactccaagatcttaggacttgaggatttccctagttcctggttttccaaatggaagtcacagtcaccaacatccaggatctgtctgaactgtaggcatcctccctgccccgaccctggtactagtgtttccaaaaggctgcagggctcagcctgatccctgttgcctgactattcctgtgatcaagctggtccccttcttcagggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggtgagtggccctcctcctaatgcacacatcctctttcttcctcttttacaaagtaaccaagttcctttgcaacacttgcctttcctctgcaacacttgcctttcctctgcaacacttgcctttcctctgtcatttttcctgcggcttagttttcattagtggttaaggctgctgactgtactgccaaactgcctgagtagtttagatcctagccccaccacttggtaactgtgtgaccctaacccttctgggccccagttttcctatttgtgaaatggagatgataaatgtagtgcttttatgaggagcaaatgagtttatccagtttgcacctgggctgctcctggcttctatgttttaaatttagctgcaaaataccacccccaccccatagtatccatttcctagttccagaaaatactctgtctgggtcatatactcctaaactaatcactctgtgctctgattggcccagtctggatgacatggtcattccttttttttttttttttttgagatggagtctcactttgtcgcccaagctggagtgcagtggtgcgatcttggctcactgcaacctctgcctcccgggttcaagcaattctcctgcctcagcctcccgagtagctgggactacaggcgtgtgccaccacacccaactaattttcatgtttttagtagagacggggtttcaccatgttggccaggatggttttaatctcttgacctcatgatccacctgccttggcctcccaaagtgctgggattacaggagtgagccaccgtgcccagccttttcttttctttttttcttttttttttttttttgatgtgaagtctctctctgtcacccaagctggaatgcagtggcgtgatctcagctcacggctcactgcaacctccgtctcctgggttcaagtgattctcctgcctcagcctcccgagtagctgggactacaggcatgcaccaccatgctcagttaatttttgtatttttagtacagacggggtttcactatgttggctaggctggtcttgaactcctgacctcgtgatctgcccacctcggcctcccaaagtgctgagattacaggcgtgagccactgcgcccggccgacacggtcattcctataggacactgtgattagccactccttcaggatcctgtggagttgggataaggatgattacccaaagaaaggcatgctggttacccaaaagagtgtctgctatattacctctgtgggaaccacatatcctgcctctgctaagagcaattccaacaatgtctctgtgacagaataaataaagtgcttttcttttaaaaaatattttaatttttttagaggtaagtgtcttgctatattgcccaggctggtcttgaactcctggcctcaagagattctcctgcctctgcctcactagtagctaggactataggcacatgccaccctgcccgagaatttttaaatttttcgtagagatggggtctcgcttttgtagagatgttgcccaggctggtcttaagctcctggcctcaagcaatcttcccgccttggcctcctgagtagttgggactacaggcgtgcaccactgtgcctggtaaagagccattctgatgaaacactcacccattcccagtatagagctgagtccaggagtccagttcctgtattcaagagctgcaagtaatgccactccccctggctcactcactctgtgactttgggccagtcttttttttttttgaagcccaggctggagtgcagtggcacaatctcggcttactgcaacctcctccgcctcctgggttccagcaattctcctgcctcagcctgccgagtggctgggattacaggtgtctgccactgtgcccggctaatttttttgtatttttagtggagacagggtttcaccatcttggccaggctggtctcgaactcctgaccttgtgatccacccacctcagcctcccaaagtgttgggattacaggtgtgagccaccgcgtctggctctcttaacctttttgaggctaagtttccacatgtgtaaaatgggtataagaattgtagctactgtatagggttgctgtgaggattaaacatgagttaatgtgtgaaaagctggttataataagctttgcataaatgggattactattattggataggtccgatctggaacctgtgaatacatagtgaatggaaacactttgaactgacccaggaagtatatggtggtggagggacgatagagtaactaccgtgaaaactttcatttagatataggggactgggtggctagagttgttaaatttgggccttgcttatgcagtttctgtctcttagcaacaggtctcagagctccatccatcccttcgctctcaggttcacccagctctcaggagttgtcacattgttctctctggggctcttggtggccttatgaggcaggcagtctgtcccctggcccaggactgtatgtattcttaaggttagcacttaataggggggaagttatgtcttctgtttgcagaggagagtacacagcaggaggtgttgaggtgggggctcaggcttcctgcagttctctgttcttccctcagtgctgtctctcttggattttgttcacctgcttttgcttacattgattttagtgggggttagtgactatggcttttccagtggccaggaggtacatgtgggctgggcacgttggctcttgcatgtaatcccagcactttgggagtctgaggtgggaggatcagttgagcccaggagctcgagatcagcctgggcaacatagtgagacccccatctctacaaaaaataaaaaaaaaatagctgggcatggtggcacacgcctgtggtcccagctatgtgggaggctgaggtaggaggattgcttgagcctgggaggtccaggctgcagtgggctgtgattgcgccactgcactctagcttgggaaacagagtgaaaccccatctccaaaaaaaaaaaaaaaaaaaaagactggggacggtggctcctgtaattccagcactttgggaggtggaggcgggcagatctcaccagaggtcaggagtttgagaccagcctggccaacctggcgaaaccctgtctctactaaaaatacaaaaattagcctggtgtggtggtgtgtgcctgtaatcccagctactcaggaggctgaggcaggagaatcgcttgaacccaggaggcggaggttccagtgagtcgagattgcaccactgcactccagcctgagcgacagagcaagactcttgtttccaaaaaaataaaaaacaggtacatatggttgtctggcccccagcagccttggtttatcagcagcaggcaaaaggagttctcttaatccagctgtgtgctgtccctgtagcccccccgcaactcagcactgccatgttctggcatcttttcttcatatgccctgctcctggcaacagtttctgcaccttagccacctccatattttggcaccttccccactcctggaatgagtttctatatcagtcacagctctttgattgcatattgtggaaaaaatccaaagtaaaataccttaaaagccagtggttatacttatttgaccttgagcctccaaaataaatatatcttgcattgtgacccagtatactcctaagtatagaataatgatggcttctaagtgtactctgtgccaggccctgtggtaagtaacatggtgttaactcatttaattctcaggacaaccttctgctatatgtactgttggtataccctctttcagatgaagaaagtgaagcacagagggattaagtgatctgcctgaggtcgtatagttggtaagaggcaaagcttgggtttgaatccaggaagtctgctttcagagtctatgcagttccaaagcagtggcaactctggaagaaaaaggctttcctaggccgggtgtggtgattcccacctgtaatcccagcactttgggtggctgaggtgggcagattgcttgagcccaggagtttgagaccagcctggccaacatggtgtagccctgtctacactgaaaatacaaaaattagccgggtgtggtggcatgcacctgtaatcccagctactcgggaggctgcgtgggaggatcacttgagcccaggaggcagaggttccagtgagccaagatcacgctactgcactccagcctgagcgacagagcgagaccctgtctcaaaaaaaaaaaaaaaaaaaggaaaaaggctttctttctctcctggcctgtttcctcagtccccatcagaaccctcatgagtccttttgttctgagctattgtgcttctggtctttttgtcctgtttatttttaggcactctttctataataggtagatttgctctttacctatgatatgggctccaaatattttttcccaacttgtcattaacttttgactttgcttattctattttctttaaatattttctttcttttcatgtattcaaaagtacccatcttttcttttatggcctctggattttgagtcatagaaaggccagagctttaatcttgtttcttgttctctgtagcgttgactatcatcactctgtgactccccccagggcccagaggccttggggagctgggggaggttgggagggtggtggttagtgagaaagtgggagcgttttcagcctaggcccaagtctcccagggcaggaggaccctgcctgcttcctgatagccgcccaccaaccctcaggacctgggctatcccttggagcttggctatcagaacttcctctaccccagtgagcctgacctccgagacctgcttctcttcttggctgagcgtctgcccaccgatgcctctgaggatgcagaccagcctgcaggtactgggtgtctgggatgtgggcgggggcggtgaggggagaggagggccttctaggggctgtagggctgagagaggtagaggtggtaaaaaggttgatgggtaggggtggcggtatgtgccttcaggagagctaggcaggaggattaggcatcagagaggggctacagggcagggggcagggggctgaggttgagctgaccccggtggtgcgttggtgcggggaggggcctccctgactcaacccctgtgccctccctctctctcacttcgctctaaccacttgggcctcctgggtgctactcaaacataccccagtacactcccgcctctgcacctttgtatcgttggttacctttcccctaggtaccctcatggttcactcccttacctctttgaggttaacctcctctccgcagccctctcctgatccccacctggctgcagtctggatggtattcaggatcctattcatgatctctctcctctgctagcttgccggctccctgagggcagggacctttatccagtttgttccacgaagtagccctagtgtctagaacagcgacctgtacatagtaggtgctcggtgtttgttgaatgactgaacgtgagaacgcaagctggatagatgtgtatctctggatgggggtcaggagtggaggctggtctcctagggtatgcccttttggatttgcagcattgacatctgattcacttcctccctatcccccataggtgactcagctattctcctccgggccattgggagccaaattcgggaccagctggcactgccttgggtcccgccccaccttcgcactcccaagctgcagcacctccaggtgagacccctgactcccatggatcttctcttgtccccgtctgggtgcccagggttttggccccctacccctggcaaccctcatcccacttcaccctggagattctgagcctgctctcccaccagggctcggccctccagaagcctttccatgccagcaggctggtcgtgccagaattgagttccagaggtggtgagcatgaggctgtggggaggggtgaggaggaaggtgggggggaacctcatagcgttgccatgcggcagggccagctgactctgttcctgcctccagagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggtacagccagatgcctggctccctgctgtctgggctgctgctcactgacactcccgctggtcctctgctctccttccccactttgtccctcccttccattgtttcccctctgtgtgtgcttacctagctccccacctgaaagaacactggagtcagaaaaaaggagaacctgggacaagtcagtatccctcctcagagccttggtttcctgtgctaaaatttggggtagtaatagtgctctcctctcagggcagtagttagactgaataatgtgcttgagattcctggcaactggagcaatccagattggctacctgccttcatcattcattaattcattcattcatttggagtcttgctctgtcacccaggctggagtgcagtggcgtgatctcagcacactgcaacctccatctcccgggttcaagcgattctcctgcctcagcctcccaagtagctgggattacaggcttgcaccaccacacctggctaatttttatatttttagtagagacagggttttgccatgttggctaggctggtctcgaattcctgacctcaggtgatctgcccaccttggcctcccaaagtgttgggattacaggcatgagccaccgcacccggccctaatctttctctgtttctgcacttgtcactgatgttcatttttctggtttctaggtttttgcacaatttctgcctgtccccattattctagttctgtgtttttgctgctcctctttcttacctctctgtctcctcgtttctgtactgaattcctctcttgctctgtctatctatctgttcccccttctcctctgtctacttctttatctgtcccctcttcttctctgtgcacctttttatctgtgtccccttctgctctgtccacctctgtatctctccccttccttgctgtccacctatatatctgtcacccctctgcctctgtttacttcttaatctctctcctcttcctctctgtccacctctgtatctgttgccccttccctctgtccccttatctctcccttcttcctctctgtccacctctgtatttgtccctcctccccttctgtccatctctttatctgtcctctcttcttctttttttttgagacggtgtctcgctctgtcacccaggctggactacaatggcatgatcagggctcaaggcagcctcaaattcccgggctcaagcaatcttcccacctcaggcatctgagtagctgggtctacaggtgcgtgcgcccggctaatttttgtattttttgtagagatggggttttgccatgttgaccaggctggtctcgaactcctgacctgaagcaatccacccaccttggccttccaaagtgctgggattacaggcatgagccaccatgccgagccccctcttcttctctgtcaacctctttgtcccctcttcttctctatccatctctgtatctgtcccctcttcccctctgtccacttatctgtcccctcttcctctgtccacctctgcatctgtcccctccttctctctgtccacctctctgtcaccctctccctctgtccatttctttatctgtccccttttcctctctgtccacttctctttttccctccctccattctgctctcctatttctgttccctcttcctctgtgttcacccaggtatcagtacccctccccttctgtccacctttacatctgtcccctcttcctctctgtccacctctgtatttggcccccctccccttctgtctgcctctttatctgtctcctcttcctctgtgtccacatctctgtctgcccctctttttctccacctctgtgtcggccccctcctggtctgtccacttttttatctgtcctctctttctgtcttcacctctgtgtctttttacatttttatttttttatcattattattattttttgagatggagtctcgctctgtcacccaggctggagtacagtggtacgatctcagctcactgcaacctctgcctcctgggttcaagtgattctcctgcctcagcctcccacatagctaggactacaggcatgcaccaccacgcccagctaatttttgtatttttagtagagacagggtttcaccatgttggccaggatggtctcgatctcttgacctcatgatccatctgcctcggcctcccaaagtgttgtgattacaggcgtgagccaccacgcctggctgtctgtttttgtttttatatctgtagtaattttcaaacataaatgtagagagaatattctagtgaatcctatgtaccattttgccaacttttcttcatcttttctctcccaactttttctttgttgctgtattattttaaagcaaatctcagacatcatgtcatttcagctctaaatacttaggactacatctcttaactcataaggacattcagttttcaaggtaaccactggaccattttcatggctaatgaagttaacaataatatcttgtgggtttttttttgttttgttttgttttgttttttgtttttttttgttttgtttttgagacggagtctctctctgttgcccaggctggagtgcaatggcgtgatgtcgcttcactgcaacctccacttcctgggttcaagccattctcctgcctcagcccccaagtagctggaattacaggagcacactaagttttgtatttttagtagagtcggggttttaccatgttggccaggctggtcttgatctcctgacctcaggtgatctacctaccttggcctttcaaagggctaggattataggcatgagccactgtacccggccaacaatgatatcttaataccatccaatacttgagttcataatcagattttcccattatcttgaaactctgttgtccctctcttgcctctctctctctgcctctttctgtgcttggtacctttgattccctgtctctgccctgtcccccgatatcctgtctatgcttctcttggatttgggggctctaggcccacccccctctcttcccacatccttctccagcatggggatctagtgggtggagagaagtatgtctgtgagcaagaggagacccctgtcctcgaggagatcccaggctggtggagcaggagagtagagcagggcctgccttagtgggaaggctggagggtgggggtgacttgtctgtatactcttgtcagggggtccttggaggaggcagggccttgggtgctaggtgggcccctacaccttcctgcttcccccgccttttctccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggtgggtgcgcctgaggacatgagatgtgtggatgggcgtggcaggcttggagggtggctttttgtgtcagcaccacacctttatccacacaggttcctgtgttcccactggacaggccctcgccccactgtgggatgggtacccagaggggtcccctagcttattagggacttgactggagaaaatgtggataggtgggaaccatgcaaaggtgtgggggtgttcttggggcaacaccccctttcctcaggcagtttcctttgagcatatcttctgtcctaagatgttcactctgagggccccccatccttctcatgggcatttgaggcttgagagatggggcaggtgggtaggagctgtgacagggtcagggagatttctccacgagcaagcactctggcccgaggttgcagatggtgcctttacccacatagtcacagtctggccaccatcggtgcttcagtgggcatgcatgccgcactgggggcagttctcaggggaggctgaggctgggccacgtgaggaagggccttccctggcagccaggatgcccctcgtcactccccttaggagccccaggcccaggccactcaggtgtcagatgtgccagccacctcccggcggcctgaacaggtgagcagagtggtttggaggggggtgtcccaggcccttgcttgtctactgggcctgacaccccaaccctgactggcctgggcctcccaggtcacgtgggcagctcaggaacaggagctcgagtcccttcgggagcagctggaaggagtgaaccgcagcattgaggaggttgaggccgacatgaagaccctgggcgtcagctttgtgcaggtaaggggcggaggaggggctgcgcgttgggctaggtcagaaggagggcctcggggtgtgagggactagatggggcaagaggtgctctgtagaggtctgcacatggcagaagggttcctgggagccattagggatctgtgggcctcttgagggtggctatgagaatcaggccagggtgagggtctgtgggcatctatggggcaccgcgggtctgcatgggcaggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggtggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggtgtctgccagatcttgtctgatacgaaggagcttcagaaggaaatcaactccctatctgggaagctggaccggacgtttgcggtgactgatgagcttgtgttcaaggtgtggggcaggttgggcgggggtgagtggggtgaggctgggctgctgccttgtgcatctgctaattggctggctggggtccagacccaggccctgtgcgaggctggaggtgcactgatacccagggctggctttgtttcatggaggatgaagctagtggggtggtgggagagggtggccttcttagggcatggagatggtcaagggcagcccactgatacctttgaggtccctgtgtctggtcaggatgccaagaaggacgatgctgttcggaaggcctataagtatctagctgctctgcacgaggtgaggggagacatgtgcctggggtggggctgctgggggtgggtgggactgggtgcaagccttctgctcctgttgtccccagaactgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagccacacacagccgatggctggacacccagccctgccccttagtgcctgtgacctgggacaggcaagtggcctactgtgagccccagcttccaccccaagggccctcctgtctgcctcccagggccatgggcagaggcttcagcttaaagatgtagggggaatcctgccacatggcgaaggatgctttgggtagagggaacaccacacgaggcctggccatgggacagagcaggctgttggagttggtgggaggggcccagagtggctgtgatgggggctggtgagcaggagctgggaaaggggctgtgtgtgctgagggggcatgtgttcacattgcctcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaagctgaggcatggatcagggctcagggaatgggagtgaggtgagtggcaggggagacacggggtatttttggcaaggcagtgtgtgtggctgtgtgtgtctgcacgggactcaagagacccactggggggctgtgcgtgtgcatatgcgtgagatacacaggtgaattctaacaggccgtgtgtgtgagcgagcacgtgttgggacctcagatcctgagggtactgacgctgcttctgtgtaggcctctgggcacacccctgtgttgacagtgcccctgtgggccctgaggctggctgtgggtgcgtgccttggggtgtgtgggttgtcagggctgtgcttgtgtgtgattgtgtgatgatgcagctttgaggttgtttgagtgtactgaggcaggctctctgtgttttggggtttgtgttgagtgagggacaggattgtgacattttgtgtgtctgtgtgacttttccagccctgaagtaatctgtgcgagcagctgaggcaggctctgtgtggctggttgtgaaggctctgtttggctgcagggctcgactggggggtgtgtctggggcggaggtgggggctggggccaggaccggggcccctctgagcagccttggggcaaaggatatgatgggggagggggtggctgccagcgggggaacaggggccctggcaggcaagacagtggaaacctcacttcttggtccctgtgggcacatccagggcctatcatccctgcccccaccacctctgcctcccaccagtttggcccctgttcgtccatcctcctttccttgatcttgaggtcaggggccaggtgtagggttggaacacctgctgggcctctggctccgtttcttgcggaactccagctcatccacggtccacacagcccccttctcgctctccacccgcacaaagcacttgtgcagactcaggttgtggcggatggcgttctgtggaaggccggggacagggagcaggtgggcgtcaacctctgaggccagcagccaccaccaacaacccacatcccgttcctccccaatgtgcctatgagcccagacccaggcctgcccactttgagctgcgatggcacttgaggccatcccagtcaccgccacctcagaggagctcaccttccaggtggcaggatggtttctgaagaaggcaaacatgcgtgtgaaccagtggtagatctcattgagtgtccgctgcttctctggagcctccaggatggcctggaagttggggggtggggtaaggggcacattccccaaacttggggtttagaggggctatgacctaccccgagccatctgacatgggggcggaattgtaggggcaggtaatcagggacaggactagatgtggggtgaagcatggggtcaaagatggggttagaaaaggggtgaagtgtcgggttgggcagggttagatgggtgtgggtatggttgttctgggattaggtaagggatcaggactgaggttgggagtggggtcttgttcagggctagggctgaagtgaggtgaaaggtctgggatggagttggagttggggttctctgtggaggtgacatttcagggttggggaaggtgaagggtcagaagtggggtcaaggatttggaaggggtaaagggccaggccaacttaagggtcagggaaggggtgggttaagagtcaggctggggtggactcaggtggggggtctaggggtgagggatgggatgacttggctttaggtcagaagccagagatggtttgaattatcgagtatcttacgtgtcagggacatggttaggtggttaggctcagggcaaggatgaggttagttgtggggttcggtgtggagtgaggctgagggtcagggaatttgatcagtttggattcaggaatgggattacagagtcagcgatgatgattgcagtgaggctatcagtcaggatggggctaggtcagggtttcagttcagagacagtcggggaatatctggtatcatgtaggggtgaggttcaggtttggggttaggtgtggcgctaggatgaaggttctgagaaggcattggggaggctgagatgaaggagttgggatggggtgatgaagttaaggatcaaatgggtgttacaaggaaaggttgggaatggtgcccagttgggggtgtattgacatactggggtacgttggggccagggaaggagatggggttgggttggcataaaggctggggaaggagttagagtaagagctggggtacgtttagggcaaggtgcagagatggggttagctttaggctattttatgggtccaggagagggttaggtatggggctgaggtggacatctggaaaggggtaggtttagggtcagaatttggcatgctctggcctggatggtggtttaggtttggatttgcggacaggtttggggtgaagccagcatgaggggtcacatttgaggcacggcttggggatccttggggctggggcttgggaatggaggaacccactctgagggcactcagagggagacaggagtttgggaggcaggtcccccaccccatctttgtcttcctcctccttggggccgagctgccctgcttacccagcggatgagcgtggcgtaggtgaaagggggtcgcatgttgtggaacttgaagtagtccatgttgtggaggaactctgtcagagggtggggatgaatcaagccccatgcaggacctcctagctagctccctgtcccctccccctacaaggtgagtctacaggcctgagatctcaccgtcaacacccgtgtccacgggcacaggtactgtttgctgagcacctgacataagttgtatcatttattctttgcaccacttctgccaaaatagttctccccgaggttgaaaagaagcggagtaacttgcacaccaaaggatgcaagaggttaaatggcagagccaggatgacagtcaaggtctctgatccctgctaagcccacaggccaggcctggtggagagcagtggataggtgagctcgggcgaatccaccccgattttccttggtcaggggaggaaaggaggtgctcctggaattacttagcagggtccctcccttctgatggccgaatatagtagctggagtccagagtgggtgaggcatggccccaatccccaagggagtcagggctaggggcccgacactcgagaccatatggggggctttcaggccacggacatcccgaaaggaagcttttgtgagcggatgcattttcccaaaggctgagtggcggcagctgcagtggtggtggtggtgggaaggggcagcatggagctcctttgcaccctccacccagagcctgtcaggattaggagcttgggggcaccgtgtagtgcaaggaccattcttacctgggaatgtgctgtttccatggctaccccacaggtgcctccggacagcaaacaggctgtcaggggcctcccgggggccagaccaggctgggacgacagggccttggctgccagcagctacgatgcagcaggagcccttgtcggatgatgcctgggtgagggggagaggctggtgacccagaggcttaaacttcccactttttactttctattttatgttttttattttttttgatactgagtcttgctctgtcgcccaggctggagtgcagtggtgcaatctcggctcactgcaacccccacctcccagattcaagcaagtcttctgcctcagcctcccgagtagctgggactacaggtgcccgtcactacgcccagctaatttttgtatttttggtagagatggggtttcaccatgttagccaggctggtctcgaactcctgacctcatgtgatccacccgcttcagcctcccaaagtgctgggattacaggcatgagccactgcgcctggctccactttatttttaaatcagtgtttttcaaagcaaggacgccctcttctaaattccagtctgaggtggaatcccacaaaacagcatgagccgtatttattagagcacaggtgcggatgtcgtatgtggccactgatgctgggaccatgaactggggttgaatagggctctttaccacccaactgtgaccttgggaaagtcacctaaacccccctggcctcaatattcctcatctgtacattcgcatcatgagaaataaattaccaccagcaaagcgctcagaaacagtgcctggcctccagggctggcttcatgggcgtgtgacctatgtggttatgtggcaccctgtgctttgtttaatgctctgtggtcgccatcttgaaatctgaacaaggggccctgcaggttacatagctggtcctgctggcacacagcctgcatctggcaagtctggctatttgcatttgctttaacaactcaggatcacagtgtttggggatcttagagtcagagggttttttttttttttttttcttgagacggagtcttgatctgtcgcctaggctggagtgcagtggtatgatctcagctcactgcaaactccgcctcccaggttcaagcaattctctgcctcagcctcccaagtagttgggactacagacacctgccaccacgcctggctaattttttgtacttttagtagacacagggtttcaccatcttggcgaggctggtcttgaactcctgacctcgtgatccacccgcctcggcctcccaaagtgctgggattacaggcgtgagccaccacgcccagccggggtcagagggtttgtaagtagaaggggacagatttccaggtctgggcatgtttggagctggggacaggggcccctagctctcaggacctgaatgtgaggttaggttccctgcaccgtgcagacctcctccctgccccccagcagtctgagtctgccaccaccagtcctggggtcgctcaccacagatgaagccttggtcagtgccattttcccagccaggtgggcctgcatggcactcagcttctccttctccagcaccagctgtgaaatggcacaaacatgaggcctcagcctggcccttctctgccacatctttgcccaggctacggtcttccctgggagtgcccgctcctcttccttcctttataccagccctcgtcccaggtgaacttggtttctggcacatggtggacagaaggttttgcgcactatccctatcccttaccctccaccgccctggcattacctgctgctccagagactgtaccatctctctctggaggagacattgtgccctgcccttctcatccagaagatggtccgcctggcagtgcctaagtagggagaagattccatgcaggtgaccacgacaggcctggtctggctcaatgctctgaatggggagggcccagaccctctgggagttctctcctctgagccccagctcccctcccctctctacctcagtctccctctcacacccctcgttcccttaacacatgcccctcagcacctactgcatgtcaggcctgaactcaccacttgagcctggccagagtgctggagataatgttggaagtgtggtgagttgagaatgggccagggaggtgagagtgggcaaagcattctgggtggagggacggcctgtgcaaaggcctggctgcaaggaggacaggacatgtggggttgctgctaagggttgtgtgtagtgtggtgtgtatttgtgtgtgtgtgtgtgtgagagagagagaaagagagagagagagagagagagagagagagagagagagagagagagagagacatatggggggactgaggggaggcagcagcagccatctagaggagctagaactttgggaacagtggaataaggctggcatgttggcatgaggagtagcagggcaaagcaggagtgcagattctagagcctggctacatgggttcaaatcccagctctgtcactcaggaactgggagattttgatcaagacacttaacctctttggcctcagtctccttgtctgtaaaatgggggtaaataacagcacaaacgtttcttattatacatacgagaaaactgaggtcgagagaagctaagtaatttgtccaaggtcacacagccagtcagggatggagctgggatttgaacccacagtctcagagtttagctcttgcatcttactacttattgggatgaagcctgagctgagatctgcaccctagacctctccccacaagccagggccggtagactggcacaggcctgggccactcacttgaggaagtcctctggctcttcgaagaccttctcacatccgggccacttgcagacaccatttgccagcagtgggtaggagctctggggcacagccgaaagggtgctggggggacagagggtgtcaggggaggggataggagggcgaggatccttcccagccctgtccactgacctgtccttcctgggtgcactgggatttgggaaggtgcagagcagtgccggctccctggacacccattccaggctggccacgttgatccctgtgggtggggacagggcacctatggaggctgtgggctgggctctggagcttggcccacaaggcctctcattttgagcttcccaccctcctgagcctcgaaaaccctgactcccagggggctctgctgtccccaaagtcccaggcttctggcagagaagcttaaagacggccattcgcaggtgctgacattttgactagctttgtaaagctctgtggttttgtgattttgacattctgcatctttaaggttctgcacctgacgttttttggagggtggagtttccaagcctctgagacctgacacctttgacccccagagtactgcaattcagaatagcctacactgctcacagccaaggatctggggacttgggggttctgtgaagccatggggtacgggctgaggtgttaccaggtgggaggccaggccgggccttgagggagaagaccccagtggcggtggtgggtggtgtgaggctgatcatggctgggctctccagggggtgcacctgcagcacaggggtccgggcgtgggcatccaccgttgagagctggggggcacatgtgggctgtggttcagcctgactcggggcccctccccacagttctcccacctgctccctcctccctgcccattcaccgtccatacctggtgcatgaaatgtggcctgtcctggaggagtgcctgtaagtggggcaaggggcccagccgtgccccggagggtgccaccatgactaggggcagtgtgggcagctgggcagaaaggcaggtgggtgagaggccatcctgatcctcactgttctgtgtctaattcaaatactctgcactgcaagcccacatggtagatgctatgatcatcccccttttacacgtatggaaactgaggctcatggagatcgagtaactttttaaagatcaaacagctaataagttgcagagctggcctcagccctgtcacctcacctacttggccccagtcctcttctcttgtcacatggggatggggacacatagctatgctcatgggactacaatacggcctcctcctctcctgagacagggattgggaggtcggggagagcctccaatctctgaggcctggcaggtggggattttcttggccctgcaacatctgcataagtcacagacttgcctgggacccagaaaccacttcctgtgccccagccagcccccctcccgcccagtgccacagtaaaggtcggcacctgtaggtccaggtaccccaccctgcctgccccatcctgggcccagggcctcacctgcagctgcgatggtggcatggggttcaaggaagaagaggaggcatgggccccgcctcgaagatctcggccctggaaggttccccctgggccccgggcccccagcaggtctgaggctttgggtgcagccctccagctgggcgaggctcctggggatgggccaagggccaaggaaggggccgagggcttgccaggcctggggttgggcatcgggtccttgtccaagggcaggctgcgtagacaataggggaaaggagtcacacgtgtgctagggcggtatgagatactcgaccacctgagccacgtggacactcctctggtcaaagcaggcattggctgggacatgtcccgaggggccccatagttgcaccccagctctagacacacacacacacacacacacacacacacaccaagaacacaggtacatgtacatacccacacatgccccacgtgcagaggtccagcacctggcttgcctgcccacgctagcacagccctggtgtggatgtgtcctctatgagggcaatggttgtttccccctccacttgagagctgtttcaagcctcaggcctctagccctccctgcaccctgcacaggctgtgtttgctcatcttgccggagctggtctcggactttctcctcggagtcctattttgccccagtgactaggcatggactcaaaagattcatctggctgctgtgagtggggctagtgaggaggctattgtaacagtcctggcaagtgatgatgctggcacagaatgggctggtggcagtggagaaggcgagaagtgggtagattctgagacttaatctgaagctggatcaggagcagtgctagcagcttggatgtagtgggcaagagggagagtcaaagtgacatgggttttagcttgagcagctggaaggaccgagctgacattacctgagatgggggacatggcggggagttggattgggtgcaaaagtgcaggtgtagatagacatgaagagtctggcattaaatatgtgagtggaggagctgagggggcagctgaatacgggggtctggatctcagggcaaggaggcgagtccaggagtgtgatcatgcacggatccagcatggcaagtgacagagaggaggagagatggggtctcttgagctggggcctgtagaagcttctctacccagcccccatcagagttcaccccaatttctggccctcaagcctggctcatgctacaccccctgcctcaaatgcccactccttctcctctttccctgtccaagccacgcaagacctgctcttctattgtcctcaccttgaaagccctccacaatggctccgggccccctgctgagccccagaaccttccactccctgagggaagcactggcttttcaggatcctataatcctggtctgagaggaagccagagctggaagggactgcccagccaaccccattatacagaaggggatgctcagatgccgagttccgtagtcccatagtgacttgagaactccacttctttctttaggaagtgtttccgtgtgcacattttataaactctctggtgtgtgtgtgtgtgtgtctccatctccccgttccacctcacagcactgagttgggcacacagctgctgagagcagcccgggggagtatagaagggttctgggggagcagttgctccttcctttctttgctgtcacctcctgggggtggttgtcagagctgtggtgctgagggagatgagtgtgagaatccaggtattaagttcttagtctcctgggggcttagaacattactgcgtgagaaacaggagtgtgggtctgtggaggctccgaacaagggcctgggagagcactggtgagatgagaaggtgagtgaatgaatgaagccagagatggggtgatgctccttcaagccaagaaataacaaagattgccagcaaccaccagaagctgggggagaggcctggagcagcttctcccttatggcccccagaaggaaccaaccctggcaacaccttgatcttggactctggcctccagaactgtgagatgatcaatttctgttgctgaagccactcagttgtggtactttgttatagcagccagaacaaactaataccgatttcggtgcaaatggatgttttccaccactctggcctggcccatgtggctggcctgtggtcacttctgaagctgcctggacacttggccagagctaagaattctccccaaacacatgtgggatggcctgactcagcaaagcatagatacattctcagacagggacatggagatgatctgtctgggggtagaggacctagagggccgggctgggcagccggcttcctgcactgtctgttgggacgtccctttctgactgggtttctcagaagctgaatgggggatgtttctgggacacagattatgttttcatatcggggtctgcatctgggccctgttgtcacagcccccgacttgcccagatttttccgccattgacgtcatggcggccggatgcgccgggcttcatcgacaccacggaggaagagaagagggcagataccccaccccacaggtttcgttccgagaactggctgccctgtcctgcagcaggcttggcccaggtggggtgacatgggtgctggtggatgtggtaggtgatgtccatctggccactatgacaagcccctagctctgaagacctggcccttcttgggttgtggagaggacccaggtttgaagctctgagagtgccaggcaggctccacagatactgggacccctggggtcttcaaatagtataacaccaggacctcagaatcatagaacagcatttcttagatttaaaggatcctagaatctcaaaaccacagactgtggggtctacggtcccaaagtctcagtatgtgtaggccagtgtccctggtgtccaaactccttggaaccatctgaaagtcaggcagcttgctgcttcatagggcctcttgcctaccaggcctggaaacagagccagcctccctagggcctcagtctccctgtccactctggaacaacgttcccaaatacatggccactccgccagagatggcaacagggggaggaggaggttgaggctggtgtgcctttggtctgggcctcatggggggagctggaaaagcctcagccttcgccaatacagagcccatcatcagactctctagaggggccccacaatcaaggttttcggggaccagcaccagctctggggacacacagcctgactgactgacatgcctccatcatcaccacgctctggccaactaggcctcctgacctatggagtccggggcctcacctagcccagctcttgtgaggctgggccccacactgtgatcgtggatcgtccaacctgtgggaagttggggtccaacgtgtgagaaggcagaagggggaatggtagcccaggttccccttcccccttctgggtgctgaggggtaaactgaggccttcagttggggagagagccagaaccagggtcccacctagagtcctgagatctaggcttggatttcaactctgccgctgcatttcggtgaggccctgagatctctggtcttcaatttgcccttctacactgagcacggagaggcgtggagtagacaagggccagggcccttctacgctgtctggttaagtcattaggtgtctgcagggcttcaagttgacaattgcccctctatccaggggactggctgagagatagggatacatagagacaaagagacacacacaaagagcgagcaagagagaacaagagatagtgagagacattgagagaaatggacacatgcatggagagccagagtgcatgtgtgcgagaggaggattgcctcaaataagaacatttgctggtctctggctggttcaactgatgctgcctgaaataatcaagaataaagaagggcaaggtgccagggacacccatggctgggtattgaattgtattgcaaagcaacaatcagcaaaacagtgtggccctggtataagaacagatactggggaagagaacagaatagaaagcttggacatggacccacatatggagagaactgaatttgtgatgaatgtggcatttcaaactggaggaccatggagtatggtttaacaaatgtgtctgagataattagggagaagataaagttattgagtgaatagtcagtccattatcccaacaacccctccctgcccagtttgaaatgtcaccatcatcatataccctaaaatgcccagatccattcaagatataagttttaacacctaatgctgatcttgggtttattgtgtgtcaggccttgtgctaagtatttactgtggttaaaaattttaatctaaacaaagactcctgaggaaggtactattataaccattgcagtacatatgaggaaatggaggtatggagaggttaagtgcctggctaaaaatcacacatagggcttggggtgacgctgggtttgtcccagacagtctggctccagtacccacactcttaacctctatagtaaatggaaaaaatgaagccataaaagagactagaagccaacataggtgaacatttatctcattttcaagtaggaaaggactttctaagcacaaaaccagagacagaagccacagaaaaaaagactaacctatttgactgtataaaaccatcataagcatcacaaaaaacaccataaacaaatagaaaaaaagcaaatgatgaattggggaaaatatttgctatatatgtaatggctgatgaaaggttaataaccattccaaataaagagctgtggcaaatcaataagggaaaaataagatgaacaccctattaggagtaaggacatgaccagacaaccaaaaaaaaaaaaaaaaaaaagcatgaatggccaatgaatagtaaaagtaatcacaagatgcaaatttcaacaatgtgataatgtgtttttcttacctgtcatgttgggaaataattaaaacataataatactcacctagggttagcttaagtagagggagcataaaataggacaaccttttggaaggagaattagcagagagggtcataaactttaaaaatgcacgccccctttgccccagcaactcccttttcaggaatccaaggaagcagtcagggatgtttatagaaaaaaacgagaaacaaccggaatgtccaacaatcggcacttggtcaaatcaatcaaagttcatgctgatgtgaggacagtcttgtccatcatgaaagatcatgtgttcaaacaatttttagtaagcttcaaaaacactactgttaattgaataaagcaggaacaaaaccaatatatagcatgattctaatttggttacagaaatactaatagctaacacttcgtgagcacttactttgtgccaaacgctgtgctaagcctgcagaatcgagctcaccccagccctgaacaacctgtttgcttcctgaatatggactctggtcacacacatgcagtcctggggtaggtccacacagctaaactacggttgacaatggtgtgaagtgctccctgcccccccgccccaagggtctcctctaaagcgatacaagcaaagttcagttaagtgctcagcttgccccggcaccttgcaatcctcctgctactagggtgaacagaactgatgctcactctcataaaatgtaaaggtcctcggcgacattactattattaaacgccagctgtgtacaaagctctaggctggatgctggctgggaaggcaggtgggggaaggcaagaaaagagagcgggagagatggaggaaaggagatcgatggagtgtggtcaagatggaggagacagagataggggagatggtcagaggccaggagagatgcggggaaagagagtctgagtgtagcgacagacagatggcgggagaaagagaggcagagaaacatgtaaaagagcaagacagggtgagcagagagacagagaaggatgagaggcatcaagagctaagagacaaagagatgagagagatgcagttgaaattttcagttgcacctggacagcatttcaagttgttcaaagctctgaaatccataaagactggcagctgacatattttaaaaatcctatccatctacgtatcaattgatgaattcatttatttttgcccctgcccatgcattaagtacttcacctttaagtcttctgccatttattctattattatttttttaaagaccttacctggctggaatcacggtagctgggtacatcccactgtaccagagggcccctgacccccccgccgtgcctacctccctgccatctcctccaatggggcccacatctggtaggggagagcagggacactcaccttggtgaagtggactgacagaaaaggatcagcctggcttgtgggaaactgtcacgtatcaaaaacaactttgcttttataccgagaagaaaaaccacgctgtacggtgtggaagccgcagacctctctcttctaataatccaaatttttttcgatgagtgtgtgcgctgataatcacggggtgggggggggttctcatagttttttttttctctctctctgtgtttctccttttcttgattatgagacttaaacggaaattttgaaattttgggtttttttctttgccctttacgagtcatctgaaaatatgatttcttcccctcaccacagaggtgagaggtatcaatgagataatagggctcatgagaaaccacagtttttaaaacaaaagtgtatagagtttgaaaaaaaaaaaacaagggaaaagaactaaaataaatcacagggccaacccgaggcaggcagagacaccattctgtgagtgagaggatatttgagggtctctggggaaagaaagagaatctgaagctctatgtgtggatgggaaatgccagggaaagagacagaatagggctgggttcccagaggcctcgccctactccaggcctcagtttccctatagatggaattgatatggtccccattgcttgaactacccggcgaggggagttctgcaccccctgcaacacccctcccacagagggtgaggggcatgtaagttacttcatggaggagaaagcggagagcccactgtcatcccctaaaattcatggacttgaagagtcggagaatccctggctcccagaatctactgacagttactgaatgaggaaagagagaaaagtctcgcctcatcacgttttagggcttgagtgccctgacccagccactgtcccactgggaaggtccctagcaggtccccaatattaatgcatccatcctcacgatgaaccccagaggcccattgggaccctgaccctcttgtttcaggaacatcatggcctgatgcttctgaggccctcagcctttggggtcttttacttcaaaaagccccagtttccaaggatttaggattccaaatatccgccatcatctcagtagctgatgtttatcttgaattttccatgggtcagatacagtgctgaacatgtctcacaagtgatcatgttcaatcctcaccatggccccttgagctccatctcatcattattgtattcctgttatacagatgagggaaacggaggtataagtagtcaagcaacttgcccaagatcacagagctggcgagtgtgggtcccgctttctttggtgctgggctttgaaatccccaagctttcctgaacttgatgttctcaggttttaaattctaggatgtgatggcagggagatcctgggatttggagagtccttggagacttgaagcttgtgaggcttttaggttgtccaggaattggcggctgcatctcttgacctcagcaggcactctattcaaccactggtcagcatggtagaccagcccccaggggcttctcctgacaggccatggtgaagacttccagctcccagcaccctgcaaagcccagggttctagtcgtccaacaaccactccagccctctacaagactggcttcagacctggggaagagaaattggaaagggctttttatttacatggtacaaatctggtggccaagatccaccccttcacccctttgccccctttcctcccccaaccttctaagccctcgtaaaaaggagggcctctttcctcaactcagactcacccttctggaaaagcccagaatgggcctgatggcctggctttgtgaagacaagaaaaaaaaaaaaaaagaatagaaaaaaaaagaccttaaaaaaatcagccaacaacaattaaaaaaaaaaaaaaaacacccaaccctccccaccattagttcaaaacaaaactttcgctggttgaggcttctgagttggtgggacacatctgagacccaaaaatggcttgggtgtgttggacagccaggggaggcaccaaggtgggatgaggtcccctgcttggaggcctgcagggaccctgtgaacagcaggtgtttaacagatgtcacggcatgtgggagggagcaagggagggggtgaggagcatgcatgtcaggaaggagtcctggggagctgattctagtgatggccccaaggttaatgaccccttgcagtgatggtcctaaggttaatgatcccttgcactgatgttcccatagttaataaccccttgctccctgcagacttgggtcggaatgttccctacacctcctgcgtaattataaaccaggccagttctatcagcagaggcattgttccctgccccagcacctgtccccctcctggaaaagggggctagttttctctctcaggatcagaggtgtgggctgcattctccttataccttccccagaccatctgtcccttactgtcactcactccatgaaagagagtggccagagatataggaggcaaacgaagtgaggatggtggccgagaatgtgagctggccccttgggcaggcccagggtgtgagagggaaatgctacggctgctgaaagccaagatccttgcagaatgggggctggggtcaggagggcagagaggggtagaggtcgctacctcccctctatactggactatatcctctctcatggagggcttctcgggaaggagactgggagggctgggagttgggggtgagtaggcaagattaaacgggtcaggaaaagtccccagagacaggggcctctgacaaagacttgaaggagatgagggagggagccagctagatatctgaggaactccaaaggaaacagccagggcaaaggtcctgaggtgggaatgtacctgatttgttcaaggtctacaagggggctggtgtggttagtgtggagagagcaagaagagaagctggaggtgaggtcagaaaggggactcggaggttagaccacgcaggaccttgtaggccatggtaaggactttggcttcaacgctgagtgaggaggaaggcatgacagggttgcaagcagaggagaaacacaaaccgtgttaggatttaacaggaagcccctgaatgctgagtgtacaatggggtctagggcctgaatgtggaagcaggggaccagcaaggagctggctactgcagtagtctaggtgactggtgatagtgctggcagtggaggtggtgagaagaggatggatttggtaaatatttttaatagacagccaaaaggatttgttgaagactgagagtcttggagccagatcgggacagacaatgcccaaaccaggtgggcaggaaggagtccctggactatttgccagcttgaacttttaggtgagaaaaaaataaagttctgtcttgcttaagcccccattattttatgatttttctgttacttgcagctgaacatattcatttctaactcatggacatcctgaacatggagacctggggagaggggctgctggaaggatcacctccctcctaggatgctgtgaggttctaatgagataacagcatgctcagaacctggcactcagtaggtgttcagtaaatcttcccaggatggagaaggaatgtatgaatggatgtgttcagcggacaaaagctgcagttgagttcccacagaaggtgagaccccaaagggagagcgaaaggagtttactagatggaagcagcagaaggaacagcactcttgggagagggaacagtagaagcagagatggggggacagaaagaagggaggtgaggcccctgtggggtgtggagtgtcaggttgggcaagaaggacagggctttgattgtgattccattagtcagaagctacccatatgcccaatcaacttctggtagcacacagtcaggtcagtgtttgctgagctgaaatttaaaaaagtgaatccttcagaaagttaaatttcctattcggccattcattcaacaatagtatcaagtcctggagagtgcttgcggctaacaatcaggggcattcttggcttgtggcactgctcaagaaaaggttgtagttgggcagggaggacccagtaagtaactaactgcaacaggacagtcattttcactttcctagttcacacaccaaggtgtggtctaggccttcaggggctctgggtattcctggggcaatggggagtcacggagggttagggagagggtaaccccatccctgagaagcacatttttcctaatggctgcctgcgttctatggttctgctgtccggccacccaatacctcagactctgtctacacagcgtcctcctctccagcctccttattggctactcatgcctcccttcacaccacctacactgcccccgtcggctctgcttttttccccatcttgcctccaagtcctccctccgtcccgctgcactatctagcctcggcattggctcatcccatactagtactgtcctttgaggtctctacgccttcaccctggctccctcattggctatccgccagctctcgtcctcgctcccgccttcagcctccacctccattggctcggctccctacacacccgcctcttggtctccttttagccttcgtattggctagctccaccttggcaccaccccttcgaagccgcagtgcacgctcacaagcctccccattggctcgctgcagccattgtcgtcatcccacgcgtggctctccattggctgttctctctctctagctaccgttccaccgcctacgcaacccgcgggatctcccactttttgggcctctgcgttcgttcccggctgccctcatcgcctgtagccattccacttttcccaccgcccacatgcctctctcgctcagacttccgcattagctgtctgcttctgttttcttcatcatggatttcgcaccacccccattccggcctctccattgattcctcgatcatcccgccccctacaccgcccactcccgggcatccccattggctgcgtgcttctccggctctcaattcgctgtacgtcatccgtgcatggctgcccattggccctctgcaatacttgtcttcatctcaccgcctatgcccccgtgagccgtacccctccgcgctggccttcccattggctgcccgccccttcaggccctgcccccgccggtcccgccgccggtgccgtcggtgccgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggtaatgtcagccagcgccacctccgccaacgcagggctgtgtctgggatggaggacaagcattccggcccaggaacccctcaggcctgctctccaggacagggaggagggtgcattgagtcagtcagtcaaagagtgatggaggtcaaacacgtgctaggcactgttttaactggggttttattcctccatttattgagttccactgtaaagccctgaacaagacagacatctaccctaccctcaaggattcatacaggctcctatgggagacagtttgaaaaaacaagcaagcaagcagataggataaatagggacaaagttagctgctgaagggagtaaggggatagattgggagggaatgactgtgtcagacatgctgttaaagggagggcctttgaggaggtgagtcccgaatgatgataaagaagagttatgcagatacggtggggaggtgggggagagtttgtaggaaaaggaacagggaggacttttctgaggaggtttcatttaaactaagtcctggatgatgaataacagttatgtgcatatatggaacaagggtgttctaggtagaggaaacagcaagtgcaaagtcctggggtggaaatgagcttggtgtgaatgatcagcagtgtgctggagtggagagaactgcaatgacatagtgtggaccaagggctttgccagtggggggtagagcagattctctttctgacagagcaggaaaccaggattccagaggtggagaaactggttgaggcagtgatggcacctggctcttccagttcacccatgcctgaccttgaagcctgtgcactctactgttaacgctgtaatctacttttgagtcctgtggaggcgaggggctgagcccatgctctcacaagaaagcagtggctctagcagagagacagaaccagatgggtactggacttgaagtttttgtcccttgtttttttgccacaccacctgtgatcatttagggacagggagaaataatcagttataccccagggggccccagaagatttccctaggtttcctctatcaagctatgagttctttaagggcagcagctagtcctgattctttttgcggtcacctaagtctggcccaggatcactagattctccctaaaatgtatacatttccctgttcctgggaggactgggaatggaaatgggaaaatgctttttggaccttgtatgtatacgcttggtcagaagcccctggctgcagtaagacatttgtgggttctgctggttctggtaaggccttaggctgtgagtggttcagaaaggtctagctccggtctggtgggcagatgtgcctgggtaactgagcaggcaggcaggtacccactcacccacctgtgagccccaccataatctgagacttcatttaaagggggcaggcagcatggtttttcttacagcattaagagtgtggattctggcatagattgcctgggttcaaatcctggcgctgccacttactggccttgtgaccttggccaacgcatttaactacaccatgcctcaggaccctcacctgtaaaacagaattatagcatctactttacgggataagagtaaaggtgctcagaaccgagtctggctcaaagtagtatcatacaggtgttagctagtgtcagtatttagggagccacacctacagtttcctggattcctctcctaaattcggctccgcccatcagctgtgtggccttgcctccgtttccttctctgctaagggaaatgacagtcactttgcatggttggattgaatgcagcaaacatgggcaaggtaactgaagcatggtggtaactgcaaaagataactggccagcatttactgatttctgtgctatgaacatcagatccattctctccgtgaggcctgctgtgcatgctgtgttgtgtaggtgctatgattatccccatttagtagaggggagacaggtagctcagagagatgagccagcttgctcaaagcctctcagctagtgagtgacagggccagggaagaaatgctagggacatttatttttttctatttttttttttttaaactggtcctctagaaagcgtggcatgattcagggcaaattctggatttcactcttggtgttcccagcatgtcgtgctttccttttacctttttttttttttttgctttatcgaggtatacctacataaagtgtactgatattctgtgtatagcccagtggatttgtacatatgtatgcacttgtgtagccaccacccagatgaagatactgagcaggtccagtaccccagagctaccttcatttctatcactttcccaagctgtcatccccgccggctgtcatgggaaccctgtctgtaagatgcgacagtttgggtaaaggagtttggtcattttaaagagtgtgaaaggcagagaacagagaaatcaaaaccttgcagggccaaggtgggtggagagggtgtttttcttttaacatacatgggcggttttaaggagaaattgaagcagcctgttcagacaattgttttggtatctggccccaggtctgtggttcctaacatgacttgtgatattattttaagtgggcagatggctttttgatagcttctttatctttcgatctcagctcttgcaaaggggaggttggtgctcattgcaagatcagcgataagggtttctttgtaggtcggtggctttcttggtgagtacatttcaacatattattgttttagaacctgtgtgctgccagtgacttgcagcactgttgaagactagccaccctttgtgacctagccctcttgggaaatggcggaggatctcagggtatatcccttacctgtgggagccctatcagagggcttcctgttgaggaaatgttggctgtaggccctctgtgcactgagcacagccacatcaggtgagggcatgggagaagtccgtggtagccatcaggatagagttcagaaacccaaatggctgctttccctgggttgctggaccaggcatttggtaactctaaagcttagagatgattcatcgacaagcatttattgactgcctactgtgtgctgggcacagtgctaggttccagcagggaaagagatgcagagtggtcctaagatgtcacagggcttgtgggatggagtacagaggatttgttgtatgagacctggctgagcccctgctcttcgccaggcacttcactgagtactatattttcatgcaaggtctggtttaattccgacaacattccctgtgaagtagagggttttaaatttctctttcctggatgagcaaactgaggctcccagagtccaaagtcctagggctggtgtggggaaaagccctcctgatcttccttggcacttgacactaccctttggaagtgtcctattcttcttaaaagtaaagaccaagagagcctcaccatggtcttcaagcaccctcccatcccattccccaatctggcctccactggctcatagtcttaacaccagtggtctttctgagctcctgtcaccatggtctttctgttactccaaagggcctcgctcctttctgctgcagggcctttgcccctgctgtttccttcaccaggaacatttatcccgtaccccttgcagtctcctccagtgttgatccctcagttctaagaggacttccccaggggagcctgtccaccccagtgtcctcgggcccctggctttttcatagcactcatcagcccagcacgtgctaagctttgttagagaatgtcccatggcagagcagatgaacatcgccaccagtcgaggggtcatcggccaccctgcctagcagttctactatatttttttgatccactcgtttctcctctgaagtgactctttcaaatgttctttaccttcagactttctctcctgcttcaaaaaacaaaacagaagccataagaatggaactccctataacttgtggcccccaagtctgcacgctgatttccctcccctgtgttacagatgacgaggagtcccttcttgctcaggccacttctccctcctgtgctctgggtcccagtttctgctacttgctctagaatctgacatcatcagtcaccttttctctcctggcaggttttctgctgccctccttgcttgatcctctattcacctttgcctgtgccagcatcccttctgtctccgctgaccccacgttctctccctcctgcttctggccagcacctcatcaccctccccttcactgctgacccctgcagagttgcctgtacttgccttctgcacttgctcacccccgtaagtgttagcccccggcatctgccagattctgcaggtggttttttagttttcctcttgaagtggttgaccactcctacttaaaacactttgtcttcccttgccttgagaccacactctgctggttttcctcttaactctctggcccttctctttctcctggctcttcccttagcttcatgtatccaaactcggcatctccacttgactgatggcccaaataattcctcaaactcaccttgtcggggactgcattcatcacctctcccacagtgttcccaagcagcctctcactcccctacctccccacttgctcgttttgcttttcagcatccttaagtaagccctgcctgaccctgtagattgggccagggacccttattctagggcattctttccttttctaaaggcactgatcgcagtttgtagttatatctttattagggggttgctggatgactctctgccccgctagactgtaagctccgtgaggggtagggacatggtctgctttcattcaccactgtattcctgcaggcctgccacagtgcctggcacttagcaggtgctcaataaatgtttgttgaaataatgagtttgagtatttttttaatgtcttcctccatactgaattgtaagcttcctagttgggtttgctcaccatggtgtctccaggatccgtcactggggctgatgcacaggaaggcccactgtctttcagtgcacctataactgaagggatggggatccaacctgctatctgagttggcagcctcaggggaaaccagaataactggagttgaacgggacaagtcaggggcatcttagttttctgtagagtgaggaattaatgtgaacgtgatcctcttttatgccacagaaaacttggtagggcattatggttaaggacatgggcctgaggccacgtgctaagaaagtggcagagctgggatctgagcctgtgtggtcctgctctagtgctccagctcttagctactgtaccaggctgggtgatgcattttaccagcagggcaacactgggcaagttgctttcctttcagagcttcagtttccctcaatggaaatttggagggggttactgttaagtgctttataggtacttttcaaatatttctttgatctgctgaacaactcactgatgtaggtattattatcccctccttagagatgaggtaactgaggcacagagaggttaagtaacttgccccaggtcacacagctgataggtggcagagctggaattgttcaaaattgcatatcctaaccctttattgagttgtgaaatcaatttactgggtttcaacaagcattaaaaagaaaaaggaaatagcataagaaatgccagtgtatcaccacatgcagtaaaggtaagtattgtttcactcgaagaacaaccatttttcagttatttatatgtctgtttacacgtgtgggtgtgctgggttatgatgtagaatggatttcttactatgggtcgtggccaaagaatgaagtcatggctgttgaagaagctcatggcacgagaaactgctctccctctaccccactggatcacccgcaagtcccagagttgaggctgacacacttgttggggaaggcaaagcagtgccccacataacttggtggctttcacagccaccttcaaaccctgttcttttcagaaagcagatggctcagggtaactgcaattctgagtatcgtggggcaggtttctgaagccactcatccccccggaaagtcagcgttatcttcaggttgactacatgggagccggggtctgctgagtttccctttgggtttcagtgcctgacccactttgggctggcaaaattctttgaaaacatgaatgctgggggtgctccagaggactcgggtggtggtggcaatggcagtctgtgactgctctgaaagtctgctttgcttttctccacagggcttgtcagccctcacccgctcgcttactctgtgactggcgaatcacctttcttggctttcttggctggcctaggccggggccaacaccacctctttccaaatcctcaccctctggtctcctcggggcctatcagcttggcagccattgtgtttcctgatggccggaggaatttgcacgcccaggagactggcgtgcaggcctgagatggccccttttagtcgacaccagcttgactagtgctcactagcacccaaatgatgcatgtccaagattttccagatctgtgtgccctggcccctatggctcactgcccttgaggggatgccacgtggtacttgtggggctggtgccaaaagaacaggtttccttcttgaaaacgagcaggcatactgcaggtacagttttgttcttaatcttctccctccccatttttctaagaacccctcttctctgttaccgatcagtgagtcagtatacatttgtacttgatttctcttactatcctcatgttgattgaagtcatagctgcccttgagtttttactgtgaaagacggttcaaagataacttgtttctttttaagcccacaatttcaaactctcttcaaagtggagccctcctggagtgtttgttaccagcgtggttgtgtagtcagtgagtgtagagatgcagttccttgagttttagtttttgcatttgtaaaaaggaagggtgttgttttgaaggatagatgtgaaggttttcaaatgccttggtgtgtcaatgagaggggcccatggtggaggaggtgaacaatacatgcttgtgctttctgctttcatatctgactttggagaacgacttgtttgcttctgtcgatgttgtggatcttgggattggctcaatggcgtgacctgctttttggatgttctcgccctcctcagccatggaaagggtgctctgggggctgaaggattgattgtgtatttgtttttctttctccttcctccaactgaattgtggagtcctttacctgctggctagctgattcctgagtgttctcctttttctgtctcacatctatgactgcagtggcttttagaagcctgtttgtaatatatgtccggactaggccagatggaggagaaggcttgcctgctactgcgcacaggtgggagggctggctttctgtctgtctgtgggccttcttgaagaggcttggtttagaagatcctaggaggaggatgttttctgtcatgaaggactatggtaacaaaaagaagtaagttagtgcagcctggcagaaattgtgttgaaacaaaagtccaaagacctggattttaggaccacggaggggattggtgtgagaccaagctggtttgctctgaatctctctttctcatctgtgatgtgtgggaggtggcagctgggctcccagagtcacccaccctaggccctgtagtattctgattcaagtacctctggtgggatttgtgagtcctagacagtagagaaagacagacggtcccttctagactctagatccgtatatatggttcaaatgttctccccgagggtgtttatagaaagcagttcttgcagccattctgtgtctagtggcctcctagccacgcatgtcccaggcccatggaggtagggaaatggggaatgaatatgtgggcaaaggcaggtccaaagaaaagcctgcatgaaggaggagggagggatcttgtctagtattgatgcctccctctatctacttctagaaaggatggagatgggttgggtaagaccccagtctccctcatccaagaagcagcagctgactgggtaagagccaaaaggcctgggttgtgatgtgaagtgtatgaccttgagccatttactcagcctctgttttatcctctgtaaaatggagacaatagtactgcctgcttcagaggattacaagtacctgtctcatagggtgattgtgaggattgaattaacacatgttgcccaggcaccgtggctcatgcctgtagtactaggacttcgggaggctgagatgggaggatcgcttgagtccaggagttcacgaccagcctggtcaacgtaggaagaccccatctctaaaaacaaaatacaaaaaaacaaaaacaaaaaccaaaaaaccccaaaaacttctttaaaaaaatgtgaagcacttagaacagtgtgtaatgccatagtaggtactatgtatgggtcagatggtgatactcgtttctgtgaaggtaattggttatgggttttcaaaaagtttcaaccaggccgggcacggtggctcatgcctgtaaccccagcacattgggaggccgaggagggtggatcacctgaggtcaggagtttgagaccagcctggccaacatggcgaaaccccgtctctattaaaaatacaaaaattagctggctgtgatggtgggtacctgtaatccctgatacttgagaggctgaggcaggagaatcacttgaacctgggaggcagaggttgcagtgagccgagatcatgctattgcactccagcctggcgacagaacgagactccatctcaaaaaaaaaaatttttcaaccattgtcagaagtatcaagaatgtcacattgcctcttaggaagaaaaaggtgtgggcattcgccccagctcctctcaggttttagtcaatgcttccctcatttaccttaatctgtagacacttgatactcattttcagaataagaacagtgacttctccatgatgagatgccacccctgggaggacccacctgaaatgcactcggcttatgccactcagggatctgactggcctggtgaaggaggagcaagacccataaatatctacagttgattcaatcccagctgtgtgtcaggccctgatttctggctgtccatcctcattcctcttgactgccctgtgcttagtgcacatcctgactccccggggctctgttttatgagtgaggaggtgaagcgacctgccaggctgatacggggacgagagggttagcatagggacccaggcctctgtgacctccctcccagtctccatttgcattccttcctctgcctcacagtcttgtctacctgccatttcttagaaaaggtgtttttgttttgttttgttttgttttgtttttgtgagataatctctcactctgtcgcccaggctggagtgcagtggtgtgatttcggctcactgcaatctctacctcttgggttcaagcgattttcctgcctcagcctcccaggtagttgggattacaggcgcccaccaccacgcccagctaatttttatatttttagtagagacggagtttcaccatgttggccaggctggtcttgaattcctgacctcaggtgatccacctgcctcggcctcccaaactgttgggattacagatgtgagccaccgcgtctggccctttttttttttttgagactgagtttcactcttgtcccctaggctggagtgcaatggcgcgatcttggctcactgcaacctccgcctcccaggttcaaatgattctcctgcctcggcctcccaagtagttgggactatgggcgtgcaccgccatgcccagctaattttttgtatttttagtagagacagggtttcatcatgttgcccaggctggtcttgaactcctaacctcaagtggtctccctgcctcggcctcccaaagtgctggaattacaggtgtaagccaccacgcccagccgaaaagatgggttcttctatcttttctctttccatagccaggaatgtatcctaaagaaatgatacaagtgtcgataaaactatgcccaatgctgtttgctggtttgctttgcaacctctaaatgaaagaacttagctgctcagtaggaagggaatggtatgatatgagtattaagcagccatttgaaatgtttgcaaaagtgtataatgatgtttcttactgttaaatggacaaagctagctgtgaaattatgtctgtagaatctaaatgatttcgtagaatatctggaaggaaattttccagaatggtaacagtagttgtctctggctgatgtgtgattgtttttcttgcttctttagactttcctgtattttgcgaattttctataatgaggctgtaggacttttaggatgaggggataaacaaaggcagcagaagagaaaacagcagctgtcaggtgaaggtgggctagcacagaggctcagaaggtgccagtgggtggcagaagtgacctctcagggtattattagatccatgtactctctcctctgccctgcaggcctgccgaggaggaactgaagacgaagaacatggatgataacacctttgccatgggtaagcaattggcaagcttcggaagttttagcttgtatttaccatgtctttcttcctactgtttttctttctataaaaatgaaaaaggctgggctcagtggctcatgcctgtaatcccagcactttgggaggctgaggcaggaggattgcttgaggccaggagttcgagatgagcctgggcaacatagtgagacctcatctcttaaaaaaaaaaaaaaaagacgggcatgctggcatgcatccgtagtccctgctactcgggaggctgagctgggaggatcatttgagcctgggaggttgatgctgcagtgagtcatgattgtgccactgcaccccagccttggtgacacatcgagaccctatctcaaaaaaaaaatgaaggggtaccctctgctttagattgtcacagaaagcttcagaggcaaaactgccagttggctaggatggcagattttcttaacaaaaccatacctacttgtatgcctgtcttgcccaatgctgcctttctcttccctctagcagagcatcctgatgtccaggagtcagtgggtccactggtagcccccacccctctccgtccatggccccagatgacacttcaggtaagtgggtccttgcagccttggagtagacagcccaataggaggctcacagtgtgactattgctgggctgggtggtggggcccactagctctgggtcctccctgggttggagggagggcacaaaactcagaacctgatgggggagggggagaatgcagttactcagctgggcttgtagaaatgtcatttgttaatttagcaaaaatttatggagtgcttgttctgtgctaagcactgttacaaacatgcaaaaacgctctttgagggggcttatgtgttagtagggtgagacatgataaagtaatagaatatatggtactttaggtgatgatgagtgataaggaaaaatagaaaggaatagggagtgggtgagagactctgtgtgtgtgtgtgtgtgtgtgtgtgtgtgtgtgtgtgtgtgtgtgtgttgtgggcgggggtcggttgcaactttagattgggtggcctgggaaggctttagtgattagtgagatctgagcgaagatctgaggaaggtgagagagtgagccacgtggataactaagggaagaacatcccaggcgagtgtgaagttcctgaggtgaggccatgactaacgtgtgtgagggacagtgtagaagccagcgcagcaggggcagaacgagggagggggagagtggtgcggggtgagggagagaggtggctgaggacagattgggtggtgcctcacaggccatggtgaagactttggcttttactccgagtgagggggagccgcaagagcattgtggacggaggagggatgtaatctgatttaggatttaacaggctccctctggctgctgcttggaaaatagacgtcagagtaagggtggaaacaggcgactcgtgaaggggaggccactgcagtggtccaggcgagagtgatggtaggtaggggaggtagagacattttggagggtgtgtgtgtgtgtgtgtgtgtgtgtgtgaactttttaattacaaaaagtttcaaacatacaaaagtaaaatagtataatgaacctacgtacaccatcccccagcttcagtaaatatcaacacgtgctcattcttattttatctgtaccccgtctcctccctcccattccctctggaattattttggaagacatccagacatcatcccatccataaatacttctgtttgtatctcagaaaattaagaactcttttttgtttttttttttgagacagagtctcactctgtcacctaggctggagtgcagtggtgtgatctcagcttactgcaacctctgcctcctgggttcaagcaagtacatccagctaatttttgtatttttagtagagacgggatccgttgccttggcctcccaaagtgctgggattacaggtgtgagccatcacgtctggccagaaaattaagaattcttaaccccacaatactatcatcacaccttagaaaataaacggtaattcctcagtatcatcaagtatttggtcagtgttcaagttttcttctctcataagtgtttaggatccaaacaaagttgacatgttgcatttgattgatgtgtctctttagatttttaaaatctcccccactttgtttctttgcaatttgttggttgaagaaactttgcttgtcctgtagaattttccagtctgggtctggctgattacatccaggtggaaatacatttcttactccatttttattaatttattaattatattaattaatgtaatcttattaaatttatttaatttatcaaattgtattaaacgaatgtatttaatcttttattattaaattaactagaattaactctatttaattctattattcccacttcctttattagctagaattcttctctaaagaaaaactgtcccacaccagctatttggctactttgagatatagtttgtgcagaaaaagcagtgtaaatatttaattttttccattttatttaccagttttcagagaagtactactacaaaggtgaccaataaaaggatttttggttttgtgtcattatgaactcatgaattctaaacatatttgaatgagtttcaatccattgcacttatttgtttgctttttttgatgcttaaattgaactatccctggctagtaggagcttattgagatgggctactctgtccttttgacacgccctcatcattctgtgagcctttctcacatcttccatgacaatatgtgctaggttcatcctgtactctccctgccccaagcctggaaacagccatttctttcttgcttttcttttctttattttctttttctttttctttcttttctttcctttcctttctttccttacctttcctttctttctttcctttcctttgtctctctctttctttcttttcttttactttatttttctttcctttctttcctctctctctctctttctttcttttttctttttctttcttttttttttttttttttttgagtcagagtctttctctgtcgcccaggctggagtgcagtggcacaatctcggttcactgcaacctctgccttctgggttcaagcaattctcctgtctcagcctcttgagtagctgggattacaggcacatgccaccacacccggctgatttttgtatttttgcagagatggggtttcaccatgttggccaggctggtcttgaactcctgacctgcctggtgatccacctgccttggcctcccaaagtgctgggattacaggcgtgagccactgagcctggccagaaacagctatttctttaaggagcactgattcctttcagtggagagtggcattcaaaggccaagatttgggggctcggcatgcttgctgctactagattggtcattgtttctaggccctttcaaaagatggagctaggaaataattgttttttaaagagaagatgatacatcatgggttcatatggacatcctggctatgttttgggatttttttgcattttattttttttaaaatttttttaatttttaatttttgaggggacatagtaagtgtatatatttatggagatgttttgatataggcatgcattgtgtaataatcacatcatggagaatgaggtatgcatctcctcaagcatttatcctgtgtgttacaaacaatccacttacactctttattttttttttttttgagacaaagtctctgtcgcccaggctgcagtgcagtggcacagtctcggctcactgcaatctctgccctctgggttcaagtgattctcctgcctcagcctcttgagattacaggcgcacaacaccacgcccagctaatttttgtatttttggtagagacggggtttcaccatgttggccaggctggtctcgaactcctagtttcatgtgatccgcccgccttggcttcctaaagtgcttggattacaggtgagagccactgtgcctggctacttacacttttagttattttaactggctctgttttgaaggtaagccagcagtatttagtgatgatcattcaccaaatattcacacccaccgaattcctcagctttataatctgcaagaagccctgttttactgcatccaattgtgttattttaccatagatgacagtctttggagtctagacagtgacagagggcgctttaaggcatttttatatagaaacccctgtggggctggctgtgggctgtcacacttcttactgtctctgcttgttccatcccctcctctgcttcattcccttgctttttctctgcccccttgccccggccatggctccaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtgtcttgcggtgtagtgttctcctgtttgggcatgagtgtgcagggtggtcactttctgtgggaggatcacagtggggagttgggggtgggacgtggtcgcctgctgctgcttcaacatgtctttccttgaagatgtgtgtctcctcgtctcgtggtcctaatccatatggttctttgtcttttccacattctgcctgtgggaccctacaggtgtgtatttggatggtggtggtgggagccagggaggaagagtggcagccacatgagggtttggtgtcagtcacatggttgcagtggtagctgtggtctcctgtggatgtggggacatcagttgtgaatcagccacaaggttttgaggttactgaaaaaacagcctttgacaccagcagggagaccccttagtccctgagataaggaaggcctcagaaaggaaagaggagttaatgtactgcagtacttggtagcacagttgctgtccacagacatcacatttctactaaaaacaggaagcccagaagctttgaaagaaagatatatatttattgcatgcaaataaaaaactgctcaacaaaataaaacaccacatatttatttacttccctttacagcaaaacctattggaagaaatatctatacgagctttcttcagttcttctatgatgcctttctgaaatagccccaatcagatcttttttgcccaaccatttcagcaaaactgctgaagatattcacattgttatagccatggttaagtctcagatgtcatcttacttgggatattggcagcatttgacatagttgatcatctctaccttgcaaccctttcttcacttggtttccaagataccacactctcctcatttcccttcttcctcactggccactgtgcaaagctgtcagttctcttgaaactgctttgtaggttcaatgcaaatccaaccacaattccaatagagttttgcctgtgtgtagatcatgacacattaattcttaaatttatgtagaagtgccaagactagccaggacactgatacttattgtaatggtatattcagatggcacgatatttttgcaagagtagacaaatcgaccaataaaaaaacagtgatctcggaaacagtgtagacacactcgtgtagacacagaactggtgaccaaggaagtgtgttagaccagtggggaaatgattggattttgaataaatagaacaattggttacccgcattgaaaaatatgaacttggatccctactttacaacacaaataaaaataattctaagtgggtttaaagcctaaatgcgaagggcaaaaccaaagcgctttaagaatacaatgaggcagggccgggtgctgtggctcactcttgtaatcccagcactttgggaggtctagatgggcggatcaggagtttgagaccaccagcctggccaacatggtgaaaccccgtctctactaaaaatacaaaaattagctgggcatccacctgtagtcccagctgtttgggaggctgaggcgggacaatcgtttgaactcagggggcagaggttgcagtgagccgagatggcaccactgcactccagcctgggccacagatcgagactccatctcaaaaacaaaacaaaacaaaaaacaaggcaaaacaccttcgtatactcatggtagcaaagtttttcttcatcacgacacagaaacaaccataaatgaaaattacgaaacattcagtgaccttaaaattaggaatgtccattgatcaaaagacaccataaagagagtgaaaaccttatgtagtaggttgctatgaataaaagcaaaacaaaaaggagtgaaaacacaagtgaaaaattgggaggagataatggaatcacatataactgatgaagggctcaaaccttagatgccaataagcatctaaataaattgtggtatattcgcagaatggaatattgtataatgagaatggaagatccataactgcacgaaagcatacagatgaatcacaaaaagccaaaaaaaagcttccacactgatccatttatgcaaagttcacaagcaggcaaaactcatgaattaccacctaaatggtgacattgtaaagaaaagcgaggggctgattaccagagtcaggatagtgttcacctctggcagagggagggatgtggctgagaaggggcccagaggacttctgggatgtcaataatggttcactgcttgacctgggagactgttcatggatgtgcaatttattcatcatcattaaaacagacttatgggctgggcgcggtggctcacacctataatcccagcactttgggaggctgaggcaggcatatcacttgaggtcaggagttcgagaccagcctggccaatgtggggaaaccccgtctgtactaaaagtataaaaattagccgggcgtggtggtgggcgcctgtaatcccagctacttgggaggctgaggcgggagaatcactagaacccaggaggtggaggttgcagtgggccgagatcgcaccactgcactctagtctgggcaacagagcgagactcttgtctcaaaaaaacaaaacaaccccccccatacatttaggttttatacactcttatgcaaagacctcacaagtgaagcagagtgcagtgggaagtgggagtagcatgagtgtccgagactcctgcacacaggcttgcagagactccagcctcctggtgtgaaccacagtgtaggcggcctccttcctgcagaacaatccctgggctccgggtcttgccttctgtttgtggagatcgactagtggggaatcctctatcgtgtgcccctgacaccagccatagagtggggcctcttgggatggacaggacctgcccatattgtcctcagatgttggggtccatctcccctcaggcctcattcacacccacaatagcccaggacacatgggctttggggcctggtgggcctcataaaagcctggaaccccgagccctggtggtgtgaccttgggcaagtcacccgtcctagaccagcctcagttccccattcataaagggggctaatgcccatcaagcagggtaggtgcaggctttggggaaaacgttgtactgccctcctcctgagcccatgttagacaggtcttatagtcaaggcagggtaggagggtggacaggaacaggggctggagcgacacagtttgggactaaattgcccagggtcacacagtgggcaagtggcttcagccctctgtgcctccctttgctcgtctgtcatcagggtaataacttttcctcctcacagggttaagtgaggaagaggtgagatgactcttcagtcactgagcagtgccaggcacagggcaagactgagtacacgcccgttgtcattccccctggctggagctcttgcaatcactgttatgcccccaccctgccctctcccattaatctgttaatgtggtgaattacattgataagtttgtacatctgtcttttaaaattgagacgcaatcttgttctgtcacccaagctggagtgcagtggcacaatcacggctcactgcagcctcaacctcctgggttcaagtgatcctccgacctcagcctcccgagtagctgggactacaggcacatgccaccatgcccagctaatttttatatttttactagagacagggttttgccatgttgcccaggctggtctcgagctcctcagctcaagcaatccacctgcctcagcctcccaaagttttgggattacaggcatgagcacgtccagcctacttttttctctctctctctctctctctctctctctctctctctctctctgtctctctcctttctttcttgacggagtctcgctctttctcccaggctggagtgaagtggcacattctcagctcactgtaacctctgccccctgggttcaagagattctcctgcctcagccttctgagtagctaggattacaggcatgcaccaccatgcccgactagtttttgtgtttttagtagagacagggtttcaccatgttggccaggctggtctcgaactcctgacctcaggtgatccacccgcctcagcctcccaaagtgctaggattacaggtatgagccaccacgactggccctacttttcttttttaaaattttagtggtcagttactagataaactctatttttatcacccatttacaggtgagggccttccatgttcttatcagccctgagctcagccctttgccgaggccttcctggtccacctctccctcctccttgtgactagggccagcatcttagtctcacagtggccccttctctctctgtcctcagccttcagccctgctatcacccacccgcatcctacaacccctctgcttcccctcttcagtgttttttgtccaggatgagaccaagtccaaacctgagcttcctgctaagtcaaagtgactttttcctttcagtcagggaagcctgactaaagcgtctggtcccacggtgaggtcttggtgtctccaacagcgcagccatggacggccaccctacagtgatacctgcctttgccagcagggggcatcttatctccaagacagggaaagcctcagagaagacgggaacagtcttaaacgttaactgcttgtagggtcacaggcctcagggtgcatgagctccaggctgggtgtcccttggagcctccctctctgcatgtggacaggtgggggcagccgagggcctggcttttactgttgttcggggtcttctacagatgactctcctcctcctcctcttcctctttttccttctaccaggaactcatttccatcactaaagagaggttctcatatttttaatcctctttatctcacttaaagggtccattataggatttttccacaagatgcactggctctgaggcctgtgcccagggcaggtcaggctatagattggccaggttggccaggttggccaggttggctgagggcaccagcctggatcctgaagacactggagacagccccaacagagcctggggctcaggaaaaggccaccaaccccccagccagatcctggccagctgccagctccgcctccacccagtcctctcccagggcctgaacgccgggtctagaagctccaggcctggtggtctgggggagacacgggccgggaggatccctcgaaagaggaggcaggagacaatctctgtatggcttgagggatgcacagctgtggggtgaggcacgccccacctagcacaggcccactgacactgctgtgcagctgcaggcccagctgctgccctctatggggctcagtctcctcacctgtgcaatgggcatcattacacccccaacgtgcaggggatgctcgtgaatggaggggagccgaggcgttgagaaagtagatttggctcaagaggaggaggagcaggtcagggttggtggggaaggatggatgcggccacctcaggcatggccggggctgccttcctcaaagtgctcaggacagtcaggtgggggaagttctgagtctgtgagcagaaccgtgggctggggaccaggtgaggttgtctctgtagtgttctggggtggccagccactgtgccactattctttcctgttggtcctcatctctgcccacggggagccccaagatgctccaagagctcacagtgagctcatgtgagttactgtgacccacatgcagtcattacagccatgtgtcatcatcacaacagccaccaggttaacacttggataatttatccaaataacgactcacctgatgtgatttgcatgatatgccatcatttattattatactcctattggatgtttaggtagtgttcgatttgcttttttgccactataaactatctgtggtgagcattgtttcccatatatgtaaacttgggagagacacaggaatgtttatatagtaaaactatttgtaatagcaaaatactggaaacaacccaattatacatcatcaggaaatgcataagtaaattatgctgtattgacatcatggaatactacacagctatgagatggagtgaactaaggtacacaaagacacaatgttaggtgaaagaagccagatacaaaagaggagatgatatatgcttttcatatatggctcaaaaccaaacaaaactagtatttaggcatacatacacctgtgttaaaacagttttacagaaaacaaggattctggccagtcgcggtgactcacgtctgaaaccccagcactttgggaggccgaggtgggaggatcacttgagtccaggagtttgagagcagcctgagcaacatggagaaccccatctctacaaaaaatacaaaaattagctaggcatggtggcatgcgcccatagtcccagctactcagaggcggaggagggaggatcacttgagcctgggaggcagaggttgcagtgagccaagatcgggccactgcactccagcctgggtgaaggtatgagaccctgtctcaaaacaacaacaacaaacaaccaaacaagcaaaaccccacacaaggattttcaactgcttgattgataccatttaaaaaatttatttaaaaaattgtcacagtagaatttactttgggggagtttctatgaattttaatatgtgtagattcatgtaaccaccactgtaattagtattcagaacagttctattaccctaaagaactccattgtgcctccccttagagtcactccctctcctcaccccctcacccacgcaacactccatcactacatttttttttttttgagatagcggctcactgcagccttgacctcctgggctcaagtgattctcccacctcagcctcccgagtagatggcactacagacacatgtgccaccacacccagctaaattttgtattttttgtagagatggggtttcgccgtgttgcccaggggtctcgaactccggagctcaagtgatccgccaacctcggcctctcaaagtgttgggagtacaggcgtgagccactgcagctggtcaggcctttcaattacaatgttgaatagcaggagtaagagtggacattcttgcctcatttctgatcttagggagaaagcatttagtttttctctattaagtatgatctaagccaggcagggtggctcacgcctgtaatcccagcactttgagaggctgagggggggtggatcatgaggtcaggagatcgagaccatcctggctaacacggtgaaaccccgtctctactaaaaatacaaaaaattagccaggcgtggtggcaggcgcctgtagtcccagctactcgggaggctgaggctgagaatggtgtgaactcgggaggtggagcttgcagtgagctaagatcgtgccactgcactccagcctgggcaacagagcgagaatatgtctcaaaaaaaaaaaaaaaaagtatgatctaagctgtaggtttttttttttttttggtggatgctttatatcaggttaagaaagttatcttcttgtttgctaagagttttttttaagatcatgaatcaatgttgaattttgtcagaagctttttctgcatgacatgatacgattatgtggttcagttactttcgaatgtcagtatggtagattgcatttattgatttttattttattttattttaatttgttttacttttttgagacagagtctctctgtcaccaaggccggagtgtggttgtgctgtatcagctcactgcaactgcctcctgggttcaagcaattctcgtgtctcagcctcccaagtagctgggactataggtgtgtgtcaccacacctgactaatttttgtatttttagtagagatggggtttccccatgttggccaggctcatctcgaactcctgggctcaagcgatccccccacctcagcctcccaaagtgctgggattacaggcatgagccactgcacccggtcacattgattgatttttgaatattgtgtcagttttgcatccccaggataagcctcacttggtcatggtgtcttatttttgtatattggatttgaattggtaatattatgttgaggatttttttttcatctatgttcatgaaggaagttgggctgtacttttcccatactttctttttttctggttttggtatcagggtaatgctatttgagaagtgttcctgtcttattttttgaagagattttgtagaattggtattatttcttcttagatgtttgacacaatttgccagtgaaaccatctggacctggcaactttatcttcttctttttaaaaaagacttttttttttttaaagagcagttttaggtttacagtaaacctgagaggaaggtacagacatatcccatatacccctcacctccacacatgcacagcctccccattatcagcaaccctcaccagcgtggtgcatttgttacaattgatcattatcaccccaatgatacatgaggtatcatattggcctgaaattttctttttttgttgtgtctctgccaggttttggtatcaggatgatgctggcctcataaaatgagttaggaaggagtccctctttttctattgtttggaatagtttcagaagcaatggtactagcttctctttgtaactctggtagaatttggctgtgaatccatctggtcctgggcttcttttggttggtaggtttttaattactgcctcaatttcagaacttgttattggtctattcagggattcgaatgcttcctggtttagtcttgggagggtgtatgtatccaggaatttatccatttcttctagattttctagtttatttgtgtagaggtatgtatagtattctttgatggtagtttgtatttctgtgggatcagtgctgatatcccttttattgttttttattgtgtctatttgattcttctctcttttcttctttattaatctggctagcagtctatctattttgttaatcttttaaaaaaaccagctcctggatttgttgattttttgaagggtttttcacctctctgtctccttcagttctgctctgatcttagttatttcttgtcttttgctagcatttgaatttgtttgctcttgcttccctagttcttttaattgtgatattagggtgtcgattttagatctttcccgctttctcctgtgggcgtttagtgctataaatttccttctaaacactgctttagctgtgtcccagagattctggtacattgtgtctttgttctcattggtttcaaataactttatttctgccttaatttcattatttacccagtagtcattcaggagtaggttgttcagtttccatgtagttgtgtggttttgagtgagtttcttaattctgagctctaatttgattgcactgttgtctgagagactgtttgttatgatttctgttcttttgcatttgctgaggagtgttttacttcaaattatgtggtcaattttagaataagtgcgatgtggtgctgagaagaatgtatattctgttgatgtggggtggagagttctgtagatgtctattaggcccgcttggtccagagctgagttcaagtcctggatatccttgttaattttctgtctcactgatctgtctaatattgccagtgaggtgttaaagtctcccactattattgtgtgggagtctaagtctctttgtaggtctctaagaacttgctttatttttatttatttatttatttatttatttatttatttatttatttatttattttttgagacagagtctcgctctgtcacccaggctggagtgcagtggcgcaatctcggctcacttcaagctccatctcctgggttcacgccattctcctgcctcagcctcccgagtagctgggactacaggtgcctgccactatgcctggctaatttttttgtatttttagtagagacggggtttcaccgtgttagccaggatggtctcgatctccagacctcgtgatccgcccgcctcggcctctcaaagtgcggggattacaggcgtgagccaccgcgcctggccaattttttgtattttttagtagaggcagggtttcaccatgttagccaggatggtttcgatcttctgaccttgtgatctacccgcctcggcctcccaaagtgctgggattagaggcatgagccaacgcgcctgaccaagaacttgctttataaatctgggtgctcctgtattgggtgcatatatatttaggatagttacctcttcttgttgcattgatccctttaccattatgtaatgcccttctttgtctcttttgatctttgtctcttttggtttaaagtctgttttatcagagactaggattgcaacccctgctttttttttttttttttttttttttttgctttccatttgcttggtaagtattccttcatccttttatttttgagcctatgtgtgtctttgcatgtgagatggctctcctgaatatagcccaccgatgggtcttgactctatccaatttgccagtctatgtcttttaattggggcatttagcccgtttacatttaaggttaatattgttatgtgtgaatttgatcctgtcattatgatgctagctggttattttgcccattcgttcatgcagtttcatagtgtcaatggtctttacaatttggtatgtttttgcagtggctggtactggtttttcctttgcatatttagtgcttccttcaggagctcttgtaaggcaggcctggtggcgagaaaatctctcagcatttgcttgtctgtaaaggattttatttctcctttgcttataaagcttagtttggctggatatgaaattctgggttgaaaattcttttctttaagaatgttgaatattggcccccactctcttctggcttgtagggtttctgcagagatccactcttagtctgatgggcttccctatgtgggtaacccgacctttctctctggctgcccttaacattttttctttgatttcaaccttggtgaatctgatgattatgtgtcttggggttgctcttctcaagaagtatctttgtgctgttctctgtatttcctgaatttgaatcttggcctgtcttgctaggttggggaagttctactggataatatcctgaagggtgttatccaacttggttccattctccccgtcactttcaggtacaccagtcaaatgtaggtttggtcttttcacatagtcccatatttcttggaggctttgttcgttcctttttattctaatcttgttttcatgctttatttcattaagttgatcttcagtctctgatatcctttcttccgcttgatcgatttggctattgatacttgtgtatacttcatgaagttctcgtgctgtgtttttcagctctatctggtcgtttatgttcttctctaaattagttattctagttagcaatttctctaaccttttttcaaggctcttagtttccttgcattgggtaagaacatgctcctttagctcgaaggagtttgttattacccaccttctgaagcctacttctgacagttcgtcaaactcattctcggtccagttttatttccttgctggcaaggagttgtgatcctttggaggagaagatgcattctgggttttgcaattttcagcctttttgtgctggattttcctcatctttgtggatttatctccctttggtctttgatgttggtgaccttcagatggggtttctgtgtggatgtcctttttgttgatgttgatactactcctttctgtttgttagttttccttctaacagtcaggcccctctgctgcaggtctgctggagtttgttggagttccactccagaccctgtttgcctgggtatcaccagcagaggctgcagaacagcaaagattgctgccttttccttcctctgggaagcttcgtcccagaggggcacctgccagatgccagccggagctcttgtatatgaggtatgtgtcagcccctgcttgaaggtgtctcccagtcaggaggcatgggggtcagggacccacttgaggaggcagtctatcccttagcagagcttgagcgctgtgctgggagatccgctgctctcttgagagccagcaggcaggaacatttaagtctgctgaagctgtgcccacagccgccccttcccccaggtgctctgtcccagaaagatgggagttttatctataagcccctgcctggggctgctgcctttctttcagagatgcccttcccagagaggtggaatctagagaggcagtctggctacagcgggtttgccaagcggccgtgggctctgcccagtttgaacttcccggaggctttgttcataatgtgaggggaaaactgcctactcaagcctcagtaatgacaaacgcccctccccccaccaagcttgagcatcccaggtcaacttcagactgctgtgctggcagtgagaatttcaagtcagtggatcttagtttgctgggctccgtggtggtgggacctgctcagctagaccacatggctccctggctttagccccctttccagtggagtgaacggttctgtcttgctggcattccaggcaccactggggtatgaaaaacaactcctgcagcaagctccatatctgcccaaacggttgcccagttttgtgtttgaaacctagggccctggtggcataggcacaggagggaatctcctggtctgtgggttgagaagaccatgggaaaagcatagtatctgggcctggatgcaccgttcctcacagcacagttcctcataacttcccttggctaggggaaggagttccccgacccctactgcttccccggtaaggcagtgccccactctacttcggcttgccttccatgggctgcacccactgtctaatgagtcccagtgagatgagccgggtacctcagctggaaatgcagaaatcacccaccttctgccttgatctcactgggagctgcagaccagaggtattactatttggccatcttgctattgctgctgtttttttttttttttttttttttttttttttaagacagagtctcactctgtcacccaggcgggagtgcagtggtacaacttcagctcactgcaccctctgactcccaggctcaagcgatcatcccatctcagcctcttgagtagctggaactataggcacaagccaccgtggcccgattaattttgtttttttgatataagttttgtagagatgaggtctcactatgttgcccaggatgggattctctggctcttaataaataattgctttttaaatctttcacaaaggaaaccttgagtgagtgaataatcaaaaggtgatagattgtttagtttctattttctgtggcatgaaggtcagtgatgctcaggatgggtgtgagtaagatgcttgtgctaagcatgctccctgccccacagtcagtctgcatgagccactgtttctaataagactgtggatagagtgatataatcacctctaaccatatcaaatgttacacgtaagtttcagattttgagacatgagttgataagatttgaagttcaaagaccatgactttagtacttcctgagtaatcaactgaaatatgttttacatatgtgttttccaaattgctgaccattcattataagtgcttctgaatttaaaggaggtacttgatgtataggtaagaaattacctttaaattctggaggtctaccctcaaagtgtatacagaggtttaattggatgtaagacacaggatcacctttagggttctgtttttttgtctatttaataaaacccaaactgtagtatgctttacatgcctttagaatcatataaataaactgctgttaagtaatgttcccagttgttatgtttctgttacaggtgaaaagcaatcacggagttaaaagaagacaagctgaaatgatgcaggctgctcctatgttggaaatttgttcattaaaattctcccaataaagctttacagccttctgcaaagtagtcttgcgcatcttttgtgaattttatttctagctttctgatgctgtgaaatatgtatcattctttgaaattttatattctaactgtttcagctggtatgcagagacatcattccttttttttttttctttttttctctttccagacagagtctcactctgttgcttaggctagagtgcagtggtgtgatctctgctcactgcaacccccgcctcctggatgcaagcaatttctgcctcagcctcccgagtagctgggattacaggagcccaccacctacccagccagattttgtatttttagtagagacggggtttcgccatcttggccggggtgctcttgaactcctgacctcgtgatccacccacctcggcctcccaaagtgttgggattacaggcgtgagccaccgcgcccgggcgagacataattcttatatattgattttctatccagcagccttgtgaaatatgcttatgaattctaaaagtttacttctagatggttttcagtcttcaacatacagaatcataccatccttgaataagaacaattttgtttctgccattttttttttctttttccttttgtattttttgtagagacggggttttgccatgtttcccgggctgttcttgaacttttgagtgcaagtgatgcacccgcctcacctcccacagtgctgagattactgacgtgggccaccgtgccgggcctgttgttgccattgtaaagagttttatttccttttctgattttatggcattgtgcagacccacctgttaaaatggtgacagtcaatatccttgtcttatccctgatgagaaaccgaaaaatttcaacatttcaccatcctatttactgtcctttttttgtagatggactttatcagagtaagtcattccattctgttccaaatttgctgagagtattcatttgaatatatgttgagtttcatcagtgcatctattttgtttataacagcatttttttcccattcatctgttaatgtagtgaattagattgataactttgtacatttttatcttctatttttaaaaatcgagacagggtctcattctatcacccaggctggagtgcagtggtgttatcagagctcactgcatccttgaccttcttggctcaagtgatcctcccacctcaggcttctaagtagctgtgactataggtacatgtaaccattcccagctaatttttcttcttctttttttttttttttgtagtgatgagattttctcatgttgcttaggctggtctcgaacacctgagctcaggcaatctgcccagctcagcctccaaaaatactagtactacaggcatgagtcttggcctggccagtttttcttatacaagggtcttctctatgtaaagactaaacttatctgtatctttgtgagggtgtgctaagggcatgatgaaatttatcattctattgatttaaagaaaactatccttgactttccagtgtgtaagtccatgaaagcataattatgttgaaagcatatattgttatgggtgttgagaaccctgcactttctgctgctgtgggagcatgtccttggaggtacctttcgtctgttttctcaactccaaacatcttaggaccatgggttgtgactggtaaggaatgtgtcttgcgagtttcaagatggagttgattttcacatggtgtcactctggctctcctgtttctctaatactggcacttctctttctgtgattctgatgctacaaatgatagatatcgttttagtattttcttatgggtcctagagattgtattcatttttctttcagtctctttctctgacttgttcacatttaacaatttctttttggggtaggttgctatttctgttttcgcaggtggtttacctgtcttctcaggcagtcaccgtggtccttgtccccatggtggggccggggcaagagagggccctggaggggaggggggtttagttgaagatggagtgagttttgaggggagcactacttgagtcccagaggcataggaaacagcagagggaggtcagattccattatcctcagtggggatgggaatcgagggttgggggcgtggggctgggaacggcagccttccccaacccgcagctgtacatgctccttggctcccgcctcagtgcgcatgtccactgggcgtcttctgctcagccgctttacccacgtggagaacgccagggagctgtgagggtgtgtggtctcgttcctgtcgtctggaatatttttcctctactgagattcatctggtaggtctgcaggccagtcctcccggggtctgaagtgtgagtgagggtgaagagcaggcagtgtgcttcgggtgagtccgttgggtcctgcttcgtggtctgtggcctctgagggagaagggcctcgaggcttctgaaagggaaggggctcctggcctctgaaagagaagggccttgaggtcgtcctccttctctcaaaggctgtgaggccaccatctgctttgtggtcgtgaaggggccaggacaaggaggaaggtgggccatggaggggaggcggtcaggggctcaggtgaagaaggggcgattgctgggtgtgctgtcagagggatggaagtccggaggtgccaggaatacccgatacaggggagatccctgaatgaggtcccggacaggtgcgaggagggcgataaagaagggacctggcacctgggaagactgcgggctggtgagtgcccctgagctttgtggagtggggagccccgagtgagaagcatcgcaagatctcacctccgccatggaaggtctggcaacagtgggaaggactgggagaggctgtgcggtccaatcaaacttgatttgagagaagtgaatggctctagtaagtgggagtgtgcccaaagtagcaatcacgagaattatgattcactaatgttttcatgtggagtccacttgtgaaactaaacctcatcagaaatgacctctgccagtggggcgccatggcctgcgcctgtagtcccagttactcgggacgctgaggtgggaggatcccttgagcaggaggtcgatgctgcagtgagctgtgatcacgccgctgcactctgccagagcaacacagggagactgcgggaccaaaagaaatttagaaaaaaaatgtcctctgcgttttgtcacacgccttaagatgattgctctgccagcttggccagcataagtggctttgtaggcactcagaaaaggtacacacatatgcttaactctgggacttattttgaaagtattttcaaaattaaaacgacaagttaacatttatccatggaggtgatggaatatagcagccctttcgagggcatgctcccaatcacggttgtctgttttcagtgtgaaatatgagttggcgaggaagatcgacctatcggtctagaccaagactctatgtagagccccctgaaatgattgggcctatgctggtgagtgcttaaacgttaattcgttgttttctattagcagaaattaatttttgtgacagtattgttgcattagtatggaaatgctgataaaggtctttcctgctcataaaaaatgatgatggcgtctcatgaaggaaacattgattctggagaattttttttcctctagtgttcttcagcttttgcccatgacttctttctcaggctttgtttgttaatgacagattgtacacatgtattccaacactgagtataatagcctccaaagtcctcgtgcgtcacttttctcatagtaaccttcctgtgggtcgagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgtgcacgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcatctttatgaatgagaaaatggaggcgctgggattgtgttttatccaagagcccttgactggtgaatacaaaatttgtattttgttccaaggtttgtgtcttcctaccatctatgttgctgtaaaaacggaaatgattttgctgaaaatgcttaaaactcaaaggctttactgtaaggtagcttagtactgacccaagaatagacccagttcagaggagcaggagcagctccaaaaaccgagtcactgaatgtcagccactgtttcctttgattgatgtttttatatggtacatttgataaaagctggataaatgaggatactgccatacaggtagctggtttagttattttctaagtggcttttaggaggtgattaaatccttttatggttagaaaaagcaaaaaaggaattatcctgagattaacattgagatagaaataatttctcctagataaaatattttcaaacaaaacatttatgtaactgaggtcatggattattccagggatgcactgttaaaaatttctagaatctgactgacaacaatgcccattaattgctgtcctcccactcccttattctcagtgtgggacagtatattttctgtgattcacaaacaatgttatatttggtgctttgttcttcacggggttcatttatggaatattacatttaggacctttggacctaaatataactttatttgaacaaaatgaagtttctatttacctcaataagtaatgggtgtcatgactgtaagattttccatagtcctcaaatccattcagctaatcgatccttcagaaattgacattgtaattgtaaccgaaatcctatccatgtggtagacttgagatttcttagctgatgcacactgctctcggtactctatggctgaatataagcattatacatgtcctgtggtttatccttagattgtcatttaggagaaaggtctcaagctgggctgaatgctgtgcacgcatagtcccagctacttgggagtctgaggtgagaggattgcttgagccctggagttgaagcccagcctgggaaacatagcaagaccttatcactaataaataaataaacaaacaaacaaacaaacagataactaaaggtttcatggtataggaaaacacagatgcaaagtttgtgcctagttgctggtaatgttgcaaacataactccttagtgaactgtaccacttaaaaatagttaagatggtaaattttagaatatgtgtattttttaccataattaaaaaaaacctcctgtcttcctaaagttcagtgtaattgtcatatattcttttaaatttttactgtatctattttcaaggcataacattatggaaaatttgcaagaatagtacaatgaactcctatacttttcacctagattcaccaattgttaatagctttcgcttcataggtttcatatcacttccctctcttaccctgcttcccacacactcacacacacacacatacagatatatgtttactgttattaatgctgaattgtttcgataaattttcaggtgttatgaccctttacaccaagtacttgagggtgtgtacatcatcagaacaaagaaaaagtaattccttggtcatcactgcagaaaaatcaaaatcaggaaatttaacaatgagaaaatgcagtcatttattacacagtgtatactcaaatttcgccagttctccagacaatttcttttttcctttttttttttttcctttgttgagacggagtctctctctgttgcccaggttggagtgcagtagtgcaatcttggctcactgcaacctacacctcccaggttgaagggattctcttgcctcagcctcccatgtagctaggactacagggcctggccaccgtgcctgagtaatgtttccttttttttgtttgtttgtatttttagtagagatagggttcgccctgttgtccaggctggtcttgaacttctgacctcacctgatctgcccaccttggcatcccaaaatgtttggattacagttgtgatggaacaggaattaaaagaaattaaagaatgtgtaagcaaaaactcagttgtatgtaagaaaacccaatttcccctgaggaagagaaagagctggagtcctttaaaattaactgcctgtttttccttctgtggctagtgagtcttatctctccctttccgaggcattgtgaagaccctgtttctctagttgtgcagctgcaaggtcactagacagataatctcaagtggtaaaacatgttgttccttgaaaagtaagaaataatgtaatgcatgtttcaattgagtaactgtatttgtttcccacttctgtaatatgcttcccctgcacagatctccccctgccccacgaaatgcttaaaagatagcttgactctttgtttggggctcagtcctttggatgttaatctgactaggtcggtgcatctaaataattaaataattcctcctcaacccctcggtctctctgattccttaattatcctgcagcatttctggtgacccggacagggattggagatggcagatttactgtctcctttgtctgtgggactagagccccacggccaggggagacctggtatccaaggcgtgccgtaggggagcttcacctggatggagactggctctcccggcatcccagtggcctagctggctgcacaacggaactggagacggggctgcagcatgataccagcacttcaggtaccacagtaaggagaaagggcccaaggcaggaaagcccatcccatagggatgaaggggagcttgatcacctcccggggaccgaccactaatccaacccagagtggctggggggcagcaggagtggcctgccaatttggatgaacctcatgtccccctaataaagtgaaagtggctcagtggtggagaaaatgggccaatagagtggcaagtgcagcaaggaagagcttgctggcagggtgcaagagtggcttgccagcccaactgggagtgtgtgggtgtgtgtgtggacctacccaggacatgagagaggctcgtttcgtctgatgaggagtcctggggtaggagtggtgtgtaggtgtgtgaatgtgggagcctaactaggctcacccaggacacgggagaggcccgttttgtccgatgaggagtcctggggcaggggacatgtgtgaaagtgtgtgaaagagacggtctcgggagaggccaatgcggggagtgacgtggggaagcacagatcccttagcgtgggctgtgtgctctgaggcaagtgcgggggaaatcagacctaggacgttgtgtacagctgataggaccagctccatggccacagcaggctgtgagaggggaaggcacgttcctggctaagcagcctctgaaactcccataataggacccagtctagtggacccgagagtgaaagtgagagtgaaagtgcgccacaagggaggaaatgggaggaaaagtgttgaaaccaactcctttggagtgcatgatgaaaaaatttaaaaaaagatttagaggtgattatgggatgaaactggatgctcaaaagttaaggacatactgtgaattagaatagccctcttttagtgtcagatggcgggccgaaggcactacagagaaattggccatgtgttttaaggtggtgactagggtcagaggacagccagggcattcagacctagtctttacattgatgactaaatgaatgcagccctgcctagcagtttattgtagaatgctcgcagctcatgccaagagaaaccagctgctctgacggctacagagttaaagggaaagtcacagaggcttgtaactccaaaagtaaaaagtgaaaagtaaaagccaaaagtgaaagtaaaaatcagctgccctggcagctatggaaacaaaagaaaagtctgaggaaggagaaaactggttttgcaagaaccacaggagggaatagagacccctcctccctacattccaatctacccccctttactaaggctaactgcccctaaggagttaagttcaaagagatacaggctcccagtctcacagaaggagaaatcagagctccaggaagttaaagtgaaaagctagaaaagtcaggtaggccgtctcaggtctggccatgccgaagttatgcttacgcctcttacgaggacaaaaggacccccactaggacccagatgatgcagtctggcttcaacacctacgaaggtgccgagaaacacttctgcaaaagctaaaggatagtaaaagaaaaagacaaccaatataaaaaatctcagaggtgctccagggtgcagataaaagcaccagccagttttaagaaagactttgtgaggcattttgggtgtacactccgtttaaccccaaggctgctgaaaatcagtgcatggtgaatacaacatttgtaagtcagggccaaggagatattaggcataaattgcagaagttagaagctccgtaggtgtgaatgctactcagcttattaaagtggctaccaaggtgtacattaactgagatcaggaggcaaagaagaaagctgatcggaggcttaagaaaggctaatttactagcagcagcccttacaggaagagaagctggctctttgcaaggagacatggacgcgggtgtgaacgcagtcatggaaaaggctagtctggacaggagtttgaaagccggccgaggctagagagagattaatgtgcacggtgcaaaaggaaaggacactagaaggataaatgtcaaaagagtaaggagaatggtcaatggcctaacacccaagagcggcgttcggttgctagttgtggtgcttccgaggcagatcctgatctgatcggcttagcggggggccgagaatttagcagactgagacagaccgggctccatccttttaggccccggggagcctatggtctctatggaagtagggggccgatcaatggatttttttggtcgatattggtgctgatttctctgtggtaacccacccgattagcccccccccacaaagaactgtgctactatcgtagggggtacaggggccaaagaaaagagacccttttgcaaatccaggagatgtattattaggggacaagaagtgcagcatgagtttctatatatgccaaattgtcgagtgcccttgttaggaagagacttactccagaaactgcaggcacaaatttcctttacacctaaagggaatatgacactggagtttggaaagtctaaggcaatggtattgactctaactgtcacaaaggctgaggaatggcggctctgtgaactgtgtgccagaaggctaccggagccagacctacacaataagtggggaatgcttttcaaggaaccaggtgtataggctgaggacaacccccctggacttgctgcaaacagacccctggtggtagtagagcttaaccctcatgctgccctggtacgagtccgtcaatatccctacccagagaggcaattgatggcataacaaaacatttaaatcggctgtatgaacataggattatagtgaaatgcaagtccttctggaatactcctctgctgcctgtgcgcaagccaaatggtgaatacaggccagtttacaaagtgtccagggacaaggcaaaagtctgttttcgggaggttggatatctaggattcatggtatcccaaggccagcgcaggcttggaagtgcatgcaaggaggctgtatgtgcattgcccaccccagtttcaaggcagcaggtcaagaaatttctgggtgcagtgggattctgccgaatctggattccaaacttctcccttacagcaaggcccttatatgaggctaccaaaggaaaagaaagagagcccctcgtataggaaaaggaacagcaaaaggccttcaaagatataaaggaagctctcatccaagccctggcgctagggttgccagatgtaaaaagcccttcttttgatatgtggatgaacggaagggaatggcagctggagtcttcactcagttgttgggctcttgacattggccggtagcatacttatccaagcgactggacttggtggccttaggttggccccactgcctcagggcgctggcagctatggcaatccttatagaagatgccaacaagctagccctaggtcagaagacaatagtctgggtgccacacgctatagtcaccttaatggagcaaagaggacatcgttggctgtccaactctagaatgctaaagtatcaagggcttctgtgtgaaaatccccagataacactggaaactataaatacggcctgtggaggaccctgattggaatgatggtgggttgcctcactgctggcaggaccttccccactgttgcataaatacggtgaacgagccgggaagatctcagagataccaccttggagagcccagatgttgaatacttcactgatggtagcagtttcataacagatgaggtgtgatatgcagggtatgcagtagtgacccaatactcggtggttgaggctcaagccttaccttctgggacttctgcttagaaggctgaattaatagcattaaccagagcactgttattggccaaggggaagaaagtaaacatatgtaatgattcaagatatgcttttgcaaccctgcatgcccatggggcaatacacaaagagagaggactattggctactgaaggaaaagaaataaaaaataaagaggaaattttgcaattattagaagccatatgggctccagagaaggtggctgttattcattgcaaaggacaccaaatcgggaagagctatgaggtgcccagcaacagaaaggcagaccaagaggctaggcaggcagcaatgagaaaggctttacctgaagaaagaactctagcaatgcctctccttatagagccccctttattggaggtaaccaattactcttcaagggaaaaagcttggtttggtcaggaaacaggaaaatatattaaaaatggatggtggctgttctctgacgggaggctagctgtcccagaaacaaaagccccaaggtttgtgaagcagatccatcaaggaacacacattggaaggacgactagaaactttgataggtcggcatttctatgtgccacggctctctgccatcgcccatgctgtttttgaacaatgtctatcctgtgcccggaataatccaaaacaaggacctactcgacttcccggaattcaggaagcaggaactgttccttgtgagaacctgcttgtagagttcactgagttacctctagcaggaggttactggtatatgctagtgtttgtttacaccttctcagggtaggctgaggccttccccaccagaactgaaagggcacgagaggtgacaaaggtgctactaaaagacatcataccaagatttgggttgcctttaaccctaggatcagacagtggtcctgcatttgtggcagaagtagtacaaaagctgactcaacttttaaagatcaaatggaaactgcacacagcctactcaccacagagttcagggaaggtggaacggatgaaccggacactcaaacagctactaaaaaagtttagccaggaaactcacttacgatgggatcaggtcttgcccatggtcctcctccaggtcaggtgtacacctacaaaacaaactgggtactcaccctatgaaatattgttcggaaggccacccccaattattaatcaaattagaggggatttaaaggagttaggagagttaacccttaggagacagatgcaggctttaggagtgggaatgtaggaggtgcatagctgggtaagggaaaggatacctgtaagtctaacagacccagtgcatccacataagccagaggactctgtctgggttaaaaggtggaatccaacaaccttggggcccttatgggatgggccccatattgtgatcatgtctacttccactgctgttaaagttgcaggtgtcacaccttggattcaccatagccgcctgaaaccagtggcagcagtgactcccgacgatgaccagtggattagccaacaagacccagattgtcccacccgaatgctcctacggcaaaacccaaccaccggtaagaaggacgactgccctgctctgaccacaccagaggctggtcagtctacatatggctgaagcttgaggatcctacaagctctgctctagtcacatcctggaagctgactagtctatgcatggccgaagctaagaggaccatctccggataattaaatgtaaatacaatttataagcctagttataattctgtcaatactgattgttctgttgttattactgcaaatgctgcaaatgtctatgctcagaagaaggtttgccatgcccatgtgtagtgtaaacatgtttctattacgtacactgatgttgttaccatttctgcctatactaaaaggggagaaatcttgagaaggatgcccacattgtgtacacactacctgggtaaaaaataccatagttaaaattctactgtaccatacctactataaatgtacaggaatcaagttaagaacctacacatacaaccagaaacagtctgcaatggtttaacacaagagaggcttagcaggaccagccctaaacatctgtatggagaaccacaaatcagatgccctgactgtaacattcagtggtctacactaacacagctctaacacttatattcaggaaggactgctctgctaaggagtatgtcaaccaaaccaaattgtaagacaaggacatgcaatcctttaaattttactatcttaaagccagagctacctttctcgtctacaggacagacagcactattacaggtaaacagacaaggagcaggccttggagttccactactaattgtcaaaaagactagaaggactcaaatgcgtccaaccccgcaatttcgggtccgtaagtcattctataagcattttgttcagtcagtgcctgagcttcccccatcaaccaaaaacttatttgcccaatcagctgcaaacatagctggcagcttatgaatttcctcatgctatgtatgtggaggaaataatatgggggaccagtggccatgggaggcaaaggaattaatgccacaagataacttcactttgcctaaccctgccagtgaaccaacagcctcagccagtgtttggttgttaaaaacctccataattgaaaaatactgtattgcccgttggggaaaggctttcacagagagagtaggagaaacaacctgcctagggcaacagtattatgataagactaaaaacaaaactctatggagaaatgcccagaatgactcctacttaccagatccaaaccctttctctcggttctctactctaagccactcttggcatctctagaggctccaaatgcttggaaagcaccctctggcctatattggatctgtggcacataggcatattggcaactgctggctaaatggacaggggcgtgtgtgttaggaacaatcaagccatccttctttctaattcctctaaagcaaagggaactcttagggtatccagtttatgaggaaaataaaagaagaactagaagaagcatattcacaaaaatagacacaaatgtcaaaaaggatgtagacataggagactggaaggataatgaatggcctcatgaaacaatcactaaatattatgggccaactacctgggcacaggatgggtcatggggatatcacaccacaatctatatgctcaactgcgtcataaggttgcaggcagtccttgaaattataaccaatgaagcatcaagggcactagatttattggcaatacaagcaacacaaatgagaaatgctatacatcaaaatagattggctttagattacctcttagcctcagaaggaggagtatgtggaaaatttaatttaaccaactgttgcctagaaatcgatgataatggctgagctgtcatggaaatcacagctagaatgcgcaagttggcccatgttccagttcagacttggtccggatggtccttggatttgttgtttggaggatagttctcaacctttggaggattcaaaactctcattggtgggtttttgtttaatcttggcatctgcctcatcctcccttttattttacccctgattattaggagtattcagtcaactataaaggcaatagtaacccgacacactacctcacagttgatggcattaaccaaacatcagctgctgccagtagaagaagaagcccagctccacgaagaggtggcaaataatggtgcttgctatgaacacctttgttatgaaaagcaccaaaggggggaaatgaaacaggaattagaagaaattaaagaatgtgtaagcaaaaactcagttgtttgtaagaaaacccaactccccctgaggaagagaaagagctggagtcctttaaaattaactgcctgtttttccttctgtggctagtgagccttatctccccctttcccaggcattgtgaagactgtttctctagctgtgcagcagtaaggtcactagacagataatctcaagtcgcaaaacatgttgttccttgaaaagtaagaaatgatgtaatgcatgttttaattgaataactgcctttgtttcttgcttctgtaatacgcttcccctgcacagatctcacctgccccacgaaatgcttaaaaggtagcttcactctttgtttggggctcagtcctttggatgtaatccaactgggtcggtgcacctaaataattaaataattcctcctcaaccccttggtctctctgattccttaattatcccgcagaagtgagaccccacgcccaacgcagataattttattgatagaattcctttttctgatccggagtcaagttcaggatcacatcttgcatgtgcttttcaggtgtttttagtttcctttaatctggaatgtttccttaatttgtctttgtcattcatgatacagacatttttgaagaggatagaccagttggtttccagaatgttctgcagtttgggctttttcatgtcttttttaaagaccttttttaaactcagcatttattgctggctagtcatgccatataacagtctaagtgctaggagtgtaagtgctgtgagagacaggatttcagccttgaatcatttaatatgagaaggacaatcagaggtagaataacaaagtgcaaaggaggcagcagagttgtctgagggcagtctctggaaaggaagagggtaatatttggaacaccttgttttcctgttttctgctaacagactcctgaaataatgttcatgggattcttatcaacatatttattattatactagctaaagcttttatataataacaccgagagcatgaatattattttcttattcatatttcatgttttactgcttaaattgatatgtattttttatttttaatggccgaagcctgaagctgatagccaggaacaggttcacccaaagactgggtgtgagtgtggagatggtcctgatggccaggagatgggcctgccaaatccagaggaggtgaaaaggcctgaagaaggtagggaatccattaggcatgcacattgtagggtgtctgtttccacagtatcgtatcataattattattacatttttgagatggagtcttgctctgtccaccaggctggagtgcagtggtggcatctcggctcattggaaattccgccttctgggttcaagtgattctcctgtatgagcctctcgcggagctgggcttatggacatacaccaatgtgcccagctaatttttgtatttttagtagagacagggtttcattatgttgcacaggttgttcccgaactcctgacctcaggtgatccacttaacttaacctttgaaattgccaggattacatgcgagagccaccatacgcgaccaaggcattatatttttaataacacaggtaacaatactgcctctttagtaagagagttcttatatgaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgggacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgtcacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagacggtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagtggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcatctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagatggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcagtggtgttatcagagctcgctgcagccttgacctcctgggctcaggcgctcctcccacctcagcctcctgagtagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactatccttgacttaccagtgtgtaaggccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtttcactctggctgtcctgtttccctaatactgtcacttcaccctctgtgattctgatgctacaaatgatagatatcgttttagcattttcttacgggtcctagcgattctattcatttttctttcagtctctttctctgacttgttcacaatgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtctgcaggccagtcatcccgggggctgaagtgtgagtgagggtggagagggccttgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagatggggtgagtgctgttggggggatggaagtcccgaggtgccgggaacccccgacgacacagggcagattccctgaatggggcctccggcgggggcgaggcgggcggtgaagaaggggcctggcacctgggaaggctgcggcctggtgagcgccccccccagcggtgtggagtgcggagcgcctgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacatgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctattattggcctagaccaagaccctatgtacagcctcctgaaatgattgggcctatgcgggtgagtgcttgaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcttttaggaggtgattaaatccttttatggttagaaaagcaaaaacggaattatcctgagattaacgtgagatggaaataatttctccgagataaaatgttttgaaaggaagcgtttatgtaatggaggtcatggattattccagggatgcactgttaaaagttcctagaatctgactgacaacaatgcccattaattgctgtccgcccactcccttattctcagtgcgggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccgtccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaatacataaatgaataaataaataaatacataaataaattcattaaataagtaaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacatagcattcatagaaaatttgcaagaatagtacaatgaactcatatactgttcatctggattcaccaattgttaatagctttcgcttcatcagtttcacatctcttccctccgtctcttaccgtgctgcccacacactcacacacacacacacacacatacatactgttattaatgctgaattgtctcgataaagtttcaggtattatggtcctttaccctatgtacttgagggtgtgtatatcgtcagaacaaagagaaagtcatttcttggatcatcactgcacaaagatgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacccacacctcccaggttctagggattctcatgcctcagcctcccgtgtagctgggactacaggcgccggccactgcgggcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattatgttagctaaagcttttatataataataccgagagcgtgaatattattttcttattcatgcgttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccgggcttacaggcgggctccgccgcgcccagctaattgttgtatttttagtagagacagggtttcgttatgttgcacaggttgttcccaaactcctgacctcaggtgatccacctgcctcgaccattgaaattgccgggattacaggcgagagccaccgtgcccgacccagcattatatttttaataacagagaggtaacaatactgcgtctttagtaacagacttcttatataaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcaggaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttattatttatttatttatttatttatttatttattgttatactttaagttttagggtacatgtgcacgttgtgcaggttagttacatatgtatacatgtgccatgctgttgcactgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctgcaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtaaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgttctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctattatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcttttaggaggtgattaaatccttttatggttagaaaagcaaaaacggaattatcctgagattaacgtgagatggaaataatttctccgagataaaatgttttgaaaggaagcgtttatgtaatggaggtcatggattattccagggatgcactgttaaaagttcctagaatctgactgacaacaatgcccattaattgctgtccgcccactcccttattctcagtgcgggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccgtccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaatacataaatgaataaataaataaatacataaataaattcattaaataagtaaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacatagcattcatagaaaatttgcaagaatagtacaatgaactcatatactgttcatctggattcaccaattgttaatagctttcgcttcatcagtttcacatctcttccctccgtctcttaccgtgctgcccacacactcacacacacacacacacacatacatactgttattaatgctgaattgtctcgataaagtttcaggtattatggtcctttaccctatgtacttgagggtgtgtatatcgtcagaacaaagagaaagtcatttcttggatcatcactgcacaaagatgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacccacacctcccaggttctagggattctcatgcctcagcctcccgtgtagctgggactacaggcgccggccactgcgggcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattatgttagctaaagcttttatataataataccgagagcgtgaatattattttcttattcatacgttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccgggcttacaggcgggctccgccgcgcccagctaattgttgtatttttagtagagacagggtttcgttatgttgcacaggttgttcccaaactcctgacctcaggtgatccacctgcctcgaccattgaaattgccgggattacaggcgagagccaccgtgcccgacccagcattatatttttaataacagagaggtaacaatactgcgtctttagtaacagacttcttatataaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcaggaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatacttttagggtacatgtgcacgttgtgcaggttagttacatacgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctgcaaaggacatgaactcatcattttttagggctgcatagtattccatggtgtatatgtgtcacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtaaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgttctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcaattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgtgtgaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcttttaggaggtgattaaatccttttatggttagaaaagcaaaaacggaattatcctgagattaacgtgagatggaaataatttctccgagataaaatgttttgaaaggaagcgtttatgtaatggaggtcatggattattccagggatgcactgttaaaagttcctagaatctgactgacaacaatgcccattaattgctgtccgcccactcccttattctcagtgcgggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccgtccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaatacataaatgaataaataaataaatacataaataaattcattaaataagtaaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatgtattcttttaaatttttactgtatgtatcttcaagacatagcattcatagaaaatttgcaagaatagtacaatgaactcatatactgttcatctggattcaccaattgttaatagctttcgcttcatcagtttcacatctcttccctccgtctcttaccgtgctgcccacacactcacacacacacacacacacatacggatatatgtttactgttattaatgctgaattgtctcgataaagtttcaggtattatggtcctttaccctatgtacttgagggtgtgtatatcgtcagaacaaagagaaagtcatttcttggatcatcactgcacaaagatgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacccacacctcccaggttctagggattctcatgcctcagcctcccgtgtagctgggactacaggcgccggccactgcgggcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattatgttagctaaagcttttatataataataccgagagcgtgaatattattttcttattcatgcgttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccgggcttacaggcgggctccgccgcgcccagctaattgttgtatttttagtagagacagggtttcgttatgttgcacaggttgttcccaaactcctgacctcaggtgatccacctgcctcgaccattgaaattgccgggattacaggcgagagccaccgtgcccgacccagcattatatttttaataacagagaggtaacaatactgcgtctttagtaacagacttcttatataaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcaggaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttcttttatttatttatttatttatttatttatttattgttatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaaaagtccccagggtgtgatattccccttcctctgtccatgtgatctcattgttcagttcccacctatgagtgagaatatgcggtgtttggttttttgttcttgcgatagtttactgagaatgatgatttccactttcatccatgtccctgcaaaggacatgaactcatcattttttagggctgcatagtattccatggtgtatatgtgccacattttcttaatccactctatcgttgttggacatttgggttggttccaagtctttgctatcgtgaataatgccgcaataaacatacgtgtgcatgtgtctttatagcagcatgatttatagtcctttggttatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtaaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgttctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcattgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatcttatgaaggaaacattgattctggaggatttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaacacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttaatagctttcgcttcatcggtttcacatctcttccctccgtctcttaccgtgctgcccacacactcacacacacacacacacacacacatacggatatatgtttacttttattaatggtgaattgtctcgataaagtttcagggattatggtcctttaccctatgtacttgagggtgtgtatatcgtcagaacaaagagaaagtcatttcttggatcatcactgcacaaagatcaaaatcaggaaatttaacaatgagaaaatggagtcatttaatacagagtgcatactcaaattttgccagttccccagaaaatttcttttttcctttgtttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcacaggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacagactttatctagagtgagtcattccattctgttccaaatttgctgagagtattcatttgaatatatgttgattttcatcaaacagtgcatctatttcgattaccacagcgttttttcccattcatgggttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgttcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggatagttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcacccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactggggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttacggtgctgcccacacactcacacacacacactcacacacacatacggatatatgtttactgttattaatgttgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatactgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagggcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcaacctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctattgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgacgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtgtgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagctcagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacactcacacacacatacggatatatgtttactgttattaatgctgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaatgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttattatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgtgcagactcacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagtgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttagtattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttgtaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatcacccatagggttctgtttttagtccatttaataaaacccaaagtgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgtgcagacccacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagccggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacagcagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacgcatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgcgcagacccacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagtgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaagcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcctgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctcccagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttagtattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgtgcacgtgtgtgtgtgtgtgttaggcattgtcacataggaggaagaggaggaaagaaaacaatggaaagaatgcctgaaattgactggaaaagcgaggaggctatgtagttcgcagcttagcttaggcaaatccctcactatggtaaaagatctcgactttatgaatgagagaatggaggtgccaggattgtgtgttatccaagaacccttgactggtgaatacaacatttgtactgtgttccaaggtttgtgtcttcctatcatgtatgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacagcagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcattgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctgctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttagtattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagccggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacgcatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgtgcagacccacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaatgtcaggatcctgcagctgctcagaagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccagggttgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagccggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttattatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacgcatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgtgcagacccacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcaggcggtgaagaaggggcctggcacctgggaaggctggggcctggcgagcccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatcgatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcctccaaagtcctcgtgcgtcacttttctcacagtatcctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggacaggatgagggagcatctgcaggtcaaggtgagggaaagggaagaagaacgtctgctggtgtgtgcgtgtgtgtgtgttcgtgtgtgtgtgtgtgcacgtgtgtgtgtgtgtgtgttaggcattgtcacataggaggaagaggaggaaagaaaacaatggaaagaatgcctgaaattgagtggaaaagcgaggaggctatgtagtttgcagcttagcttaggcaaatccctcactatgataaaagttctcgactttatgaatgagagaatggaggtgccagggttgtgtgttatccaagaacccttgactggtgaatacaacatttgtactgtgttccaaggtttgtgtcttcctatcatgtatgttgctgtaaagaaggaagtgattttgctgaaaatgcttaaaactcaaaaggctttactgtaaggtagcttaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctcccagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatcattatactttaagttttagggtacatgtgcacgttgtgcaggttagttacatatgtatacatgtgccatgctggtgcgctgcacccactatcttatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgtgcacgtgtgtgtgtgtgtgttaggcattgtcacataggaggaagaggaggaaagaaaacaatggaaagaatgcctgaaattgactggaaaagcgaggaggctatgtagttcgcagcttagcttaggcaaatccctcactatggtaaaagatctcgactttatgaatgagagaatggaggtgccaggattgtgtgttatccaagaacccttgactggtgaatacaacatttgtactgtgttccaaggtttgtgtcttcctatcatgtatgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctcccagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaataaataaatggataaataaatacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttgtaccacaattggaaattcctttcttcctaaagttcagtgcagttatcatatattcttttaaatttttcctgtatgtatcttcaagtcatagcattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatgctgaattgtttcgataaagtttcaggtattatggtcctttaccctatgtacttgagggtgtgtttatcgtcagaacaaagagaaagtcatttcttggatcatcactgcacaaagatcaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacccacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccggggttacaggcgtgctccgccgtgcccagctaattgttgtatttttagtagagacagggtttcgttatgttgcacaggttgttcccgaactcctgacctcaggtgatccacctgcctcgaccattgaaattgccgggattacaggcgagagccactgtgccagacccagcattatatttttagtaagagagagttaacaatactgcctctttagtaaagagttcttatataaaggttatttgaaatgtagttcaggccccagcacccgagtgatagactttcagatagggaaacaagctgagtcaaaggtatgttgaattaaaagttttgagtataaatcctcaaaccagtagctcataattttcaaatgcttttgcaaaggtctgcttttaatcaatacataacacatttgtaacacccatcacttggtgtgaaaaatgctgaagcactcatgcgggttctaatatcagctcttacagccttggtgagattctgagtgagtcctttcacttctaaacctatctttggttgttatgaaaatagtgagtttaagtcagagattttaaaaccattttccattccggttctttcatactctgatcctgttgcatagaatgcgtgggacacagagatcatctgcttcgcatggtttgttaatcacaaatcatgaaaccctggcccgagtcatctgaaaatctctgaattgagatttcattgttagtaagaaagtgagggggcactctgcttcatcctagtttttccgtgtggagagctgaatacgtagtgtaagatcttgtgaaattgtgaattctccctcttcttggtttgtttgtttgtttgcgacggagtctcagtctgtcacccagggtggagtgcagtggtgtactttcagctcactgcaacctctggctcccaggctaaagcagtcctcccacctcagcctcctgagtggctggaactacatgcacaagccaacgtacctgagtaaaattttttttttcatttttgtagagatgaggtctcactatgttgcccagactgggattctctggcttttaatgaacaattgcttcttaaatctttccccacggaaaccttgagtgactgaaatatcaaatggcaagagaccgtttagttcctatcatctgtggcatgtaagtcagtgatgctcagcatgggtgtgagtaagatgcctgtgctatgcatgctccctgccccactgtcagtcttgatgagccactatttctaataagactgtagacacacatatgatataatcatctctaatcatatcaaatgttacatgtaaatttcagctttagagacatgaattgataagatttaaagttgaaagaccatgactctagtccttcctgagtaatcaactgaagtatatttcacacatgtgttttccaaattgctgactgttaattgtaattgcttgtgacttgaaaggaagcacttgatgtttagggaagaaattacctttaaattctggagggctactctcaaagtgtattccgagattcaattggatatacgacagaggatcaccttagcgttctgtttttagtccatttaataaaacccaaactgtagtgtgctttgtatgcctttagggccatctaaataatctgttgctcagccgggcgctgtggctcacgcctgtaatcccagcactttggaggccaaggcgggtggatcatgaggtcaggaattgtataccatcgtggctaacacggtgaaaccccgtgtctactaaacatacaaaaaattagcccttgtggtggcacgcgcctgtggtcccagttactcaggagtctgaggcaggagaatcgcttgaacccagaaggcggacgttgcagtgaaccagattgctccactgtactccagcctgggcaacagagtgagactccatctaaaataataataataataataataataataataataataataataatctgttgctctgtaatgttcccaactgttttgttttgtttcaggtgaagggcaatcacagtgttaaaagaagacatgctgaaatgttgcaggctgctcctatgttggaaaattcttcattgaagttctcccaataaagctttacagccttctgcaaagaagtcttgtgaatcttttgtcaattttatttctagctatttgatgctgtgaaatgtttcattctttgaaattttgttttctatctccttgagctgtgtgtagaggcataattctcatgtattgattttctatccagcaaccttgttaaatatgcttatgaattttaaaagtttacttctaggttttttcaattttcaacctacagaatcataccatttttgaataagaacaattttgtttctgccttttttgtttgttttttcttttgtatttttcgtagaggtgggattttggcctgtgtcctaggctttttttgaactcctgagcgcaagtaatccactctccttggcctttcaaagtgttgggattacaggcatgggccaccgtgctggtcctgtttttgccattttaaacccttttatttccttttctgattttatggcattgagcagatctaccggatacaattgtgatagtggaaatttttgtgttattcctgatgagaaatggaaaaatttcaacatttcacgacaatatttagtgtactttttttgtagatggactttttcagagtaagtcaagccattctgttttagtttgttgagagtgttcattttgaatatatgttgaatttcatcaaacactgacctgagtcatcttaaaacatgtgaattgagatttctttgctactaagaaagtgagcgggcactctgcttcatgtttacttttgtcatgttgcatgaaaaacattttgcttcatgtttgattctgtatgttgaaaactgaaatcatctattgtgattaccacagggttttttcccccagtaatctgtttatgtagtcaattacgttgataaatctgtactttttaaattttaacaattgagacaggtctcactctgtcacccatgctgactgcagtagtgtgatcacagcttactgcaacctcaacctcctgggctcaggcgatcctcccacctcaccctcctcagtagctaggactataggtacatgccaccatgccaagctaatttttctgttttagagatggtattttttcatgttgcccaggctggttttatactcctaatctcaagccatccactagcctcagcctcccaaagtgctgggattacaggaatgagtcacggtgcctggaaattttgtacatttaaaccaacaatttggtcatgggtaatctatgtcctaataatttatttaaggatttttatgtatatcctcatgagtgacattacctgtacttttatttcatatgctcatttgttggacgttgttatcaaggttcctctagcttcataaaacgggttggtatgtaaaacctctttttccattcactggaactcaagtctcctcaaggctgtgagtaatgcagggctaggctttcccataatgagcttttctagaatgcttctctcagatttggaccctacttaaacagcagtgaccaaacgggcagctccaggtacctatcccctcaaactttgtgagggtcgcgttctctgaagatgcctcttcaatttgaaagctatctgttcctgtttctctgctgatattaactctctgtgcacagaaagttaaacgtcactggttattaatttccctagattttgatctgtgctgtgtggctgagaatgggctgactgaccctagatctgtgtataattatgacaatggctctatttatttttaaaataagaggaattattataaaattcctatttactggatgtgtactatctatgaattacttctttgtgctaggttgtgtacatgtatgacctctttagatcctcacaagataaggcagaattttcatgaaattgatgactgactccagtaagaagcagatttggggggatttcaatttctaagctcaaagcccttgcacttttctcaaagtaaagcttttgaaagtgttaaatgtacacgaactgatggtgtatatgatgattttagttgtaatctgatgttttctttaaaaatttacatatacaaaagtgtttgactcaaaaggctttgttcttcccttaaaggaagcatctaccaaaatgtggcacacaaaccttgcatggtgtctctagggcctcctaccccgcatttcccctgctttttctcttgttctgactgaaaaacaaagtgctttgactgtgctgtgacccagccagctgcatgtttacccagcatgcttgaacccaagctggagccttgaacataaaggtgtttaagttgttgctcaaaatatggaaagaatctagctctggccttgaaccaaatcccttaaactctcctataaaactccataacctgaccccctcagtgcggatatacctaggcatgacattcttgttgcctgttgcgaggatgctttagcctactctaagttctcccaataaatgctttggactgatcaccctggtgtttaatgttccttggaaatcttgacaggcccaatctctagtcggtctggggcactaccttgtgggaactctcctacttctgcttcctgctccggccgtggatttggctggatgaaatcattaatacaaaaacaaacatttaaaaacgttttttcatgataatgtgcttattatgttacagaaaatataacactaaagccatttgcaacagtttgtggggagaaagttaagaacgtgtgtcacaaatcgcatggcaaagtgccacaacatctcctacaaacacatctgtcctttgaagttactcacaggtggggagggagcagccacaaatctctttttttcttccacaaaatcctctgttggcttgatagtcaagagatctcactcagaagcccctccttgctgcccgattccagacctctaccgctattactatacacaaagacaggttacacctctgaggtcttgtttccatcttcacagcaccccccaccccaagaaaacagttctgccaaaaaaaaaatcctattcagaatccaccctgcttagggaatgacaagggattataaacaacagtgatttctccctcttgcagatgcttaaaaatatttcctgatccaagaggactgaaaatctatgattcaagtaaagagtgaggctaaatgcagggtatctcaatttaccccaaatacatgaggggtcccttggttgtggaggtggcagaaaggattagaacctatatagaagaaaagggaaagcaaccaggaaaatttgcttagacaaaattacttgggtcctacttacactgtctccttaataggcagtggcatgaaatagccatgggtttccatcctggctctgacacactgactttgcaatggtgaaatggtgggaaaggttcttacattctttgggcctgtttccccatttctaaagtacgaattaaaatatttacgctaaatgattgctatgaagaatgagatgccaatacatatggtgtttcccacgagggatatgttcggtggggcagacagacacataaacagaagagcagttggggtgcacacatacacacacaccccgaaagtgaatggggtagctaagaagcaagagaaaaacaaggagaaaagccttgtgagagtgaaagagatctactggacttctcatatccactgatcactgggttcatctacttgattctgttgatataaggctgaatgacggcagggcatggaggctcacacctgtaatcctagcaatttgggaggctgagcaggaggattgtttgagcccaggagttcaagaccagcctgggcaacagagcgagaccctgtttttttttttttttttgagacagagtctcgctctgttgcccaggctggagtgcagtggcacaatattggctcactgcaaactttgcctcccaggctcaagtgattttcccacctcagcctcccaggtagctgggattacaggtgcacgccaccacacctgactaatttttgtatttttaatagagatgaggtttcacaatgttggccaggctggtctcgaactcctgacctcaagtgttctgcccaccttggcctctcaaagtactcggattacaggcgtgagccaccacgcctggcctctttattttttgaaggctgagtgacatctgtgcctcacacttgaaaactaaaataaccagaatggcagtattgtgcttattcaaaaagtatttattgagggctgtttctttatcagctcctttatatatgagaagacatcagcaaattagccaatgtagcccctaactgagaaatgatctaagaaagtagcagtgtcccagattcattataaatgtaaaagtgtttaatatttataaaatattatatattcactataaatacaaaagtataaaaggtaatacattggtactagatgcttctgggcaaagtgcgtggtgaagggcacaagccctctgtgacagatccccaagacaaccttcagcttgatgatcttccagacgcacaggattcagaagttgttatactcacagttataatctattaaagtgaaaggatacagattagaatcagcaaaggtaaaaggcacatggggtgaaatccaggagagaccaggggcaagattttaggtgttttttcccagtagagtgatacagggacacgtttatatactgtcccagtaacgatgtgtgacaacacgtgaagtattatcaaccagggaagctcacctgaccttggtgttcagggtttttattgggagtcatgtaggcatgcaaaacttgtgtaactgacctcagctactcagactctagccttcctgagcaaaaacaaacattcaccataaatcacattgttaaacaaacttattggatcccactgttaacagtgtggcccaaagactcaggcataaaaaacactcttatcaggcagtcctgctgagttaatcctttcctgcacaaactcctctaagagaacagaagtttgcaaagagagatttcctgtgatgtctcatctgcaatgtattatttccagtaagcaaattactagtttaataatggctacacttaagtaagcaaggagcatgtcatcatctctctctctcccaacaataacaacagcagcaacaacgaaacaatgcaaaaaccaacaacaaaaacttgtctgagaatcagctgctgggaatcaggctctgtgccctgggctagaaagactgaggatcgagaaatgattcatgcaggataagagttatcacagagctcagagtctactcccaggggatgatgtgtgttctaagtactgctgcactgtaaataactttttatttatttattatttagtaataaatattatttatttattacttattaataaataaataaatttatttttactgtcacccaggctggagtgcaatggcatgatcttggctcattgaaacctccatctcccaggttcaaacgtttcttctgcctcagccttccgagtagctgggattacaggcgcccatcaccttgcccggctagtttttgtatttttaatagatggggtttcaccatgctggccaggctggtctccaacttttgacctcaagcgatcaacctgccttggcctcccaaagtgctaggattacagacgtgagccactgcgcccggccagtaaataacttttattttattttattttattttattttattttattttattttattttattttatttattttttgacaagagtctcacttcttgtcacccaggctggagtgcagaggcatgatctcggctcattgcaacccccgtctcccgggttcaagtgattctcctgcctcagccttccgagtagctggaattacaggcgcctgccaccacgcctggctaatttttgtatttttagtagagatggggttttgccatgttgaccaggctggtcttgaagtcctgacctcaggtgatccgcccgcctcagcctcccaaagtgctgggattacaggcatgagccactgtgccaggccggtaaataacttttaatctctgttcattatcccccttttcattaaaaaaataaaaatctcactgctcaattattctcatgttatagatgaggtaacgagatcagagaagataagtatctcattcatggtcaagtcagtagtccctggtgcagccagttttcaacctaggactcttggaacacccatgtacttttcattataagcattttttgtgctcttaatatcgtcttctgttttaattcacattcgccataaatacagttccttgctcagcttgcccccagagtccctttttattttacagctttattgctaaagtgccaacatgtttttcagaggctgagacattttgcactcttactagcagtgtatgagggctgcatttgctctacatctccatgaacacttgatactaccagttttttacattttagccattctaataggtgtgtagtcatacctccttgcagttttaatttgcatttcaacacgttgaacatattttatttttttctctctctctcttttttctctctctttctctctctcttctttctcttttcttttctttttctttctttctttccttgagtcttgctctattacccaggttggagtgcagcggcatgatctcagctcactgcaacctctgccttctgggctcaagtgattctccctgcctcagcctcccaagtagctgggaccacaggcgtgtgtcaccatgcccccgctaatttttgtatttttagcagacacagggttttgctgttttggccaggctggtctcagactcctgagctcaagcgatctgccagcctcagcctcccaaagtgttgggattacaggtgtgagccaccgcacccagccagggaattttctttgccagggaattttcttttctattcttcttcttcttcttttttttttttttttttctgacagagtctcgttctgtcgtccaggctggagtgcagtggcaccatcttggctcactgcaaccactgcctccgggttcaagcaattctcctgcctcagcctcccgagtacctgggattacgggtgtgcaccaccatgcctggctaatttttgtatttttttagtagagacggggtttcaccatgttggccaggctggtcttgaactcctaacctcatgtgatctgctggcctcagccttccaaagtgctgggattacaggaaattttcttaatctaattctagaccatttttattaagactttatttttatattgtttcactccttttgcctatttattcaactttctggaaggtttgcttacctggctttttcaagtcttcccattgaatgctttttattaactacctgatttccaggaaatttttagaaatctacttttgtttcacctttgtaaaaagcaagaccgggcacggtggctcatgcctgtaatcccagcactttgggaggctgaggtgggcagatcacttgaggtcaggagttagagaccagcctggtcaacatggcgaaaccctgtctctactaaaaatacaaaaaaaaattagccaggtgtggtggtgggcacccataatcccagctatttgggaggctgagccaagagaatcgtttgaacccaggatgtggaggctgcagtgagttgagatggtcccactgcgctccagcctgggtgacagagtgagagtctgactcactctctctctctctctatatatatataatatatatataattatatataatacaatatattatattaaataatataaataaaataaaataagaagcaaaaataattctactttttctgacttaatggatgcctaaaacatagacgtacagcttacccaattaaactctccttgttgagttctgataccagtatcatggcaacttcctacaaaataatggaaagtcattctttccctccccagtggaagggttcacatagccctggagttgtatggtgcccatagactttcatgccctgacattcctcagccttgacaacaacctaaatgtttttattttgttttgtttttgaaaaggataaacgatggcctgtggagacagggattttttagttgtatcaacatgggagtgctttcattgagctaatctcagtttagggcaaactgaaagtcagggaaactggctgatgcctgtttttctccctgttgctcaatgattgtctttgattcagaaatttgagtgtggaggcacttgaagggaagatggaaattgtgggcaatggtgaaaggtgggaagattttttttttttcttacagaaaaagatagacccatgaagtttggtttatttagattccagtctacccattaaaggtgtctggaattgtcttcttattgttcaggctttggatcacagacctctgtcaggaactgtgtggctgcatcagaagccatgcagaagacaggttctagcccccatcagccagggcacctggcagaggaaatattaacctaggctactgggattattgtcccaggtaaggtacatagttattatacacaaactggtctatgtcacagggaatgaaggcctcaggaggaccacaaccctaccccacccctagacttgtctattgggtgtcatgacactgagacatccacgatgaattccgaagagaggtaccagctccaccaggctgctcaggccaagagtctcaggtcaatgagggctacaggcatctgaaattccagaactcgcaggatgagtgtttgcagaagttgtggcacctcctcctccttcaccaaaactgtctgctttggtatactggtaacagccattgattagttttaaaagtttatttattttaaaattgtaataaaatacatataacataaaatttaccatcatggctttttcttttcctttttttttttttttttttgagagattgtcttgcccttttgcccaggctagagtgtagtggcacaatcatagctcactgcagccttaaactcctaggctcaagtgatcctcccgtctcagcctcttaagtagctgggactacaggcatgagctgccatgcccagataagttaaaaattgttttttagagatggggtctttctatgttccccaggctggtcttgaattcctggcctcaagcaatcttcctgcctcagcctcccaaatccctgagattacaggtgtgagtcaccaagctcagcccattttaggcattttaaagtgtacagttcagtagcattaagcacatttacatcatctatcattttcaagaactttttcaccttgcaaagctgaaactgtacttattaaaccatgactttctatttacccttctgtctccctctttcactcctgatattggttttatgtcttctctttgttttttgtttttttgtatttttggtcagtctggctagttagatcaattttattaatctttccagggaactagcttttggtttcattgattttttttctattgttattcattttcaattgtcttgatttcttctcttatctttattatgttcttccatcagcttgctttaggtttatttgtctttttctcattttgtaaggtggaagcttagatgtgaggcttttgtttctattttttcttcctattgtccaaacccaagctttcatttctaacgtaagcatttcatgctataatttttcctctaagcactgctttatgtcacaaattttgatgtgttgtgtttttggtgtcatttaattcaaactattttctaaactgctttgcgacttattatttggttataaataggttatttataagtatgttcaatttccaaatatttggagattttctagatatttttgtcattgatttctagtttagtttcattatagttagaaaacatcctgtgcattatttcagctcttttaaatgtgtttagatttttgttatgacctagataatccaagattatctccccatgtcaagatgcttaacttaatcacatctgcgaagttcctttgccgtgtaagataatatattcacagatcctggaaattaggatatgggcatctttgggggccatattcttcataccacaccccgtttccctccctaagcgtttgtagtgactgtcactgtccccacattggaccacagaggtggacacggatggggcctagctctgtcaatacaaggagaaaaatacagcagtggttgacagccactaggaataataataatgacaatgttgataataacagctaccatttaccccaggcttggcatgtgccatcgctttgcagggatcataggtgccaccattcctattctacaacgagaaatctgaggtccagggaggctctatgatttgcctggtgtcacacagatggcaggcagcagaagagccagggttagtgctcagactttctctgcagcctgtgcccctaagccctacctcaagtcattacccctgaggagttggagggaggcctcctcagagtggatcatttatggagctagacctgtaggatggattttaggaattcgctagtggccaaatagctatcacttctggacctgcaaagaggctgtttgacttcacctttctctctctctctgtctctctcccccttcctccttctctctctctctctctctgacacacacacacacacacacacacacatacacaccacacacacacacacacacacacaccatggtgtcttatattcatggtttaacttctattgctcagggttacttatgagtggggtgggaatcatgacccataacacacacggcagcctgccctacacaaaactctgcagctagtgtagaaacacccacagccctgtctcccattaaagtggcctctgttgttgaaggtcagcaggaggcagtctaggggagttagtttcctgtgggcatcttgggaatgggtgagcagcagactgtgaatggtgcaggtgtctggatcaggacttctgggacacctcactatatctttccccaaatccctatgcctgctggctactggggcctgtcacaacatccctgttaaggcagaactggaaatgtctcccagatccagatgaaacttcagatccagactgagagtccagggcaatttacctagggctggaagaggtggggtgatattcctgaaggaggcactggggtgagtgtcacctcaggagatgggaggacactgcagagctgggtctgtgaggacagagaagggaccctgggagggacaggagcagcgtgagcatagggagtgccccaactgcggtcatcctggcattggcatctggccccagctctgccccaccctagctggagggcctgagccagggacctgccttctcagtgcctcagtgtcctcatctgtgacagaggtgacagggttttcttccaagggtcctagtgggaattaaatgagatagcacataagaagggcttaggatactgcaagtcagatctgtgattacctaaaacaaagttctttaaatttaagattgatactttcttgttacggctcaaggaaaaaataaattaattaattaaaaaataaatttaagattgaaagcttcatgacacttttaccatatttcatcaaatctcagatgctatagattgtgtgtcacactcttattgtaagtaaccctaagaaagaaagaatgctactaattgaactctgacctgttgccttctcaactcagtgactgtatgatgcattcctgatttcagatacattaaaatattttaaggctgagtgcactggctcacactggtaaacgcagcactttgggaggccaaggcaggatgatcacttgagcccaggagttccagaccagcctgggcaacatagagagaccccatatctacaaaaaagtaaaaaattagccaggcatggtggtgcatgcctgtagcctttgctacttgggaggatgaggtgggaggatcatttgagctcaggagtttgacatgcagcgagctataatcatggcactgcactccagcctgggtgatagagtgagaccctatcttaaaatatatatatttatgtataatataaaaatatattttaaagtacattttagaattgataaaataggacatttttcattatttaattttacagttaccttctgtggcaattgtttctaattttgtatagtgatagaatcttttcaaaacatttcgtttaagaacaaaagcgatttgaccttagggaaactttgagatggctctactagtctgaaagggattgtgacagggcagtcccctcaggtgggaagtgagtgactggagttcaggaaccactgctgaagtcatgcctcagggcatgcctggcccctcagcctctcccagctgcccagaaggaccttcctgggggcagatacacaatcacaccccatggtgcccactttgaggatggatgcccaggttgggatggaaggaggaggagttaatccactgattcagcatctgtccaaggatgcccacacaacatcaggtgcatcctgactgctggaaacccggcagtcacacaagcatcacacaaatcctcaggagtcacagtctggtgagggaggctgacacacacaaacacaacaaaaataaaaagaaaaggaaaagcatagcagtaggtagttatgaggatggaactctggatccagatggactaggttcaaatcctggttccatgatttcccagctgtgtgatctctggcaggttacttaacctctctgtttctcaggtgcctcatttgtaaaatggaggaaaaaaattatttatttcattcggttattgtgaggactattaggtgagttaatatttgtgaagaacttagaatgggtcctgacataacattaaatattcaatatgtgcttgctaatgaaaacactttaaagcatcgaattagaagtgcagcccatgaggccgggcacagtggctcatgcttgtaatctcagcactttgggagggcaaggcttgcagatcatctgaggtcaggagttcgagaccagcctggccaacatggtgaaacccccatctctactaaaaatacaaaaattagtgggacgtgatggcgcacacctgtaatcccagctactcaggaggctgaggcaggagaatcacttgaacctacgagtcagaggttgcagtgagctgacatcaggccattacaccagcctgggcaacagagagagactctgtctgaaaaaaaaaaaaaaaaagaaatgcagcccacggaagatcaagaagggaaatgggaagagaacataatgtaaagtggggatgctaaaagcactaccctccaaggtttgctgtgcttatttcattacgtctttcttaacgtgtagtcatagtgttaagtctccatcccttagcaggagccctgtccccctcctccattctggatgccacttttgttattgcagctccaggctccgagattttcctgtgactcccaactgaactggttggcgctttccgaactgatatggagccccctttccttgcctgaagtccagttgggcttcaggactttacaccgggctccctggaggaggtctgtctcctccccactgttaggatctggggattcttgtcctctcattgtcagtctgaatgagtctcattgtatcttcattcaagtcataaaggttaaggtcagccaatggtatttgtcagtgagtgaatgaagactgaccaaatgaagcaaaaagagatggcttaccatctcccaagctcctgagtcagccctccccaagcccacccatctgagacagcctatggagtggtgtggggccagacctcaggttaacaaagctctgtcttcccctccctctgttgggatgaggcactaggctgttgggattggacacacacacacacacacacacacacacacgcacacacacccatccacttttccctgcttacagtgttgtcctgtaaaaggcattctccctgccccctgtcccccgcaggcacacacaggtcctatctattctttttttttaattttattattattatactttaagatttatggtacatgtgcacaacgtgcaggtttgttacataggtatacatgtgccatgttggtgtgctgcacccagtaacttgccatttagcattaggtatatctcctaatgctatacctccccgctccctccaccccacaacagtccccagtgtgtgatgttccccttcctgtgtccatgtgttctcattgttcaattcccacctatgagtgagaacatgcggtatttggtttcttgtccttgcgatagtttgctgagaatgatggtttccagcttcatccatgtccctacaaaggacatgaacttatccttttttatggctgcatagtattccatggtgtatatgtgccacattttcttgatccagtctatcattgttggacatttgggttggttccaagtctttgctatcgttaataatgccgcaataaacatacatgtgcatgtgtctttatagcagcatgatttataatcctttgggtatatacccagtaatgggatgactgggtcaaatagtatttctagttctagacccctgaggaatcgccacaccgacttccacaatggttgaactagtttccagtcccaccaacagtgtaaaagtgttcctatttctccacatcctctccagcacctgttgtttcctggctttttaatgaccgccattctaactggtgtgagatggtatctcattgtggttttgatttgcatttctctgatggccagtgataatgagcattttttcatgcgttttttggctgcataaatgtcttcttttgagaagtgtctgttcatatccttcacccactttttgatggggttgtttgtttttccttgtaaatttgtttgagttcattgtagattctggatattagccctttgtcagatgagtagattgcaaaaattttctcccattctgtaggttgccggttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcatttccctattgcttgtttttgtcagggttgtcaaagaccagatagttgtagatatgtggcattatttctgagggctctgttctgttccattggtctatatctttgttttggtaccagtaccatgctgttttggttactgtagccttgtagtatagtttgaagtcaggtagcatgatgcctccagctttgttctttaggcttaggattgacttggccatgagggctcttttttggttccatatgaactttaaagtattttttccaattctgtgaagaaagtcattggtagcttgatggggatggcattgaatctacaaattaccttgggcagtatggccattttcacgatattgattcttcctacccatgaacatggaatgtacttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatatttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaatcaaatgccctttatttccttctcctgcctgattgccctggccagaacttccaacactatgttggataggagtcgtgagagagggcatccctgtcttgtgccagttttcaaagggaatgcttccagtttttgtccattcagtatgatattggctgtgggtttgtcatagatagctcttattattttgagatacgtcccatcaatacctaatttattgagagtttttagcatgaagggctattgaattttgtcaaaggccttttctgcatctattgagataatcatgtggtttttgtctttggttctgtttatatgctggattacattgattgattttcatatgttgaaccagccttgcatcccagggatgaagccgacttgatcatggtggataagctttttgatgtgttgctggattcggtttgccagtattttattgacgatttttgcgtcaatgttcatcagggatattggtctaaaattctctttttttgttgtgtctctgccaggctttggtatcagggtgatgctggcctcataaaatgagttagggaggattccctctttttctattgattggaatagtttcagaaggaatggtaccagctcctgcttgtacctctggtagaattcggctgtgaatccatctggtcctggactttttttggttggtaagctcttaattattgcctcaatttcagagcctgttattggtctattcagagattcaacttcttcctggtttagtcttgggagggtgtgtgtgtcgaggaatttatccatttcttctagattttctagtctatttgcgtagaggtgtttgtagtattctctgatggtagtttgtatttctgtggaattggtggtgatatcccctttgtcattttttattgcgtctatttgattcttctctcttttcttctttattagtcttgctagcggtctatgaattttgttgatcttttcaaaaaaccagctcctggattcattgattttttgaaggattttttgtgtctctatttccttcagttctgctctgatcttagttatttcttgccttctgctagcttttgaatgtgtttgctcttgcttctctagttcttttaattgtgatgttagggaatcaattttagatcttttctgctttctcttgtgggcatttagtgctataaatttccctctacacactgctttgaatgtgtcccagagattctggtatgttgtgtctttgttctcgttggtttcaaagaacatctttatttctgtcttcatttcgttatgtacccagtagtcattcaggagcaggttgttcagtttccatgtagttgagtggttttgagtgagtttcttaaacctgagttcttgtttgattgcattgtgatctgagagactgtttgttataatttctgttcttttacatttgctgaggagtgctttacttccaactatgtggtcaattttggaataggtgtcgtgtggtgctgaaaagaatgtatattctgttgatttggggtggagagttgtgtagatgtctattaggtccgattggtgcagagctgagttcaattcctggatatccttgttaactttctgtctcattgatctgtctagtgttgacagtggggtgttaaagtctcccagtattattgtgtgggggtctaagtctctttgtaggtcactagggacttgctttatgaatctgggtactcctgtattgggtgcatatatatttaggatagttagctcttcttgttgaattgatccctttaccattatgtaatggccttctttgtctcttttgatctttgtgggtttaaagtctgttttatccaagactaggattgcaacccctgcctttttttgttttccatttgcttggtagatcttcctccatccctttattttgagcctatgtgtgtctctgcacgtgagatgggtttcctgaatacagcactctgatgggtcttgactctttatccaatttgccagtctgtgtcttttaattggaacatttagcccatttacatttaaggttaatattgttatgtgtgaatttgatcctgtcattatgatgttagttggttattttgctcattagttgatgtggtttcttcctagtcttgatggtctttacaatttggcatgtttttgcagtggctggtactggttgttcctttccagcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttcgtctgatgggcttccgtttgtgggtaacccgacctttctctttggttgcccttaacattttttccttcatttcaactttggtgaatctgacgattatgtgttttggagttgcacttctcgaggagtatctttgtggcgttctctgtatttcctgaatttgaatgttggtctgccttgctagattggggaagttctcctggataatatcctgcagagtgttttccaacttggttccattctccccgtcactttcaggtacaccaatcagacatagatttggtcttttcacatagtcccatatttcttggaggctttgttcgtttctttttattcttttttctctaaacttctcttctcgcttcatttcattcatttcgtcttccatcgctgataccctttcttccagttgatcgcattggctactgaggcttctgcattcatcacgtagttcttgggccgtggttttcagctccatcaattcctttaaggagtgctctgcattggttattctagttagacattcgtctaatttttttcaaggtttttaacttctttaccattggtttgaacttcctcctttagcttggagtagtttgatcttctggagccttcttctctcaactcgtcaaagtcattctccatccagctttgttccattgctggtgaggagctgcattcctctggaggaggagaggcactctgctttttagagtttctggtttttctgctctgttttttccctatctttgtagttttatctacctttggtctttgatgatggtgacgtacagatgggtttttggtgtggatgtcctttctgtttgttagttttccttctaacagtcaggaccctcagctgcaggtctgttggagtttgctggaggtccactccagaccctgtttgcctgggtatcagcagcggtggctgcaggacagcggatattggtgaaccgcaaatgctgctgcctgattgttcctctggaagttttgtctcagaggagtacccggctgtgtgaggtgtcagtctgcccctactggggggtgcctcccagttaggctactccggggtcagggacccacttgaggaggcagtctgcctgttcccacatctcaagctgcgtgctgggagaactactactctcttcaaagctgccagacagggacatttaagtctgcagaggttactgctgccttttgtttttctgtgccctgcccccagaggtggagtctacagaggcaggcaggcctccttgagctgcggtgggctccacccagttcgagcttcccggccactttgtttacctactcaagccttggcaatggcgggcgcccctcccccagcctcactgccgccttgcagtttgatctcagactgctgtgctagcaatgagcgaggctccgtgggcatagcaccctccgagccatgcgcgggatataatctcctggtgtgccgtttgttaagcccattggaaaagcacagtattattagggtgggagtgttccgattttctaggtgctgtctgtcacccctttctttgactaggaaagggaattccctgaccccttgcacttccctgatgcggtgatgccttgccctacttcggctcatgcacggtgtgctgcacccactgtcctgcacccactgtctggcactccccagtgagatgaacccggtacctcagttggaaatgcagaaatcacctgtcttctgtgtcactcacactgggagctgtagactggagctgttcttattcagccatcttggctccacccccctcaggtcctatccattctgcatcatgtctagtgaggggggtctctgtggtataacatgaaccccatggttaattttactctgcaagtcattggctataagtggtcatttagagtctcccccaccccaggccagtagtttgctgcggacattgttgtccacattgctctgtgcgcacgtgcgagtgttttttctttctttcttttttttttttgttgtttttgagacgaagtttcattcctgttgcccaggctggagtgcaatgggaatcttggctcactgcaacctctgcctcccaggttcaagcaattctcctgcctcagcctccccagtagctgggactacaggcatgcaccaccacgcccggctaattttgtatttttagtagagccggtatttctccatgttggtcaggctggtctcaaactcctgactcaggtgatcctcccacctcggcctcccaaggtgttgggattacagtgagccaccgtgcccggtgagtgttttttcttttaacgtcacattcttacaagtggaatggtttcgtcaaaggagccattcattcaacaaacacctaatgactgcctactctgtggtgggtgctgttctaggtgctgggaatacatcggggaattagaaggccatatgtgcctgccttgatggagcggaaattcttgtgaaggatgtttccagtttttattttggtagatgctgccatattgctgtccaattaccggcatcctcagctcactcctggggtgggggctttgaggcaggtgaataaacgccttggcctttgctctctgcatgatcttcagggtcaggacctgggacgggcgatccctctggggtcatgagtatgaaataacgggaggtggggatggaatggtccactggggagtagggaggtggagaaggaacggtttgcaaggcatttgcacagaagcttccttgatcgcaccactagggggcctacggaaggaggggacaacaaatcaaggatggaaacatcctgccaggcgataccactgcggtaggcagagacagaacagtcagctctgggaggcaccactgggtagggggcttggatcaaaccattgtgtgtgttggggggactcgaagggccgcttccaccccatgcaagtggttgcagcccaagactctgaagaaggcaggaatcacgctaccttgactgtccgtagctcacacccaccctctcgtttcccatcccaggcaggcaccagctagcatgacaggcctccacctctcctcgggtccagtcccagctccttgggcaccgccttctttggctttttgactttgaaactgtggcttgcgcttgcaggggcacgtgattggatccaagcagaagggagcgggctgcaaggctcgttctcggatctgactggtcaacgcgagctttcatttctcctaagctttttctgcgcgcaaaaggggcaaactcccgcacctcaactcggtcgtgcgccgacctccaattggccgctggttcggcgcaggcgcaatggttgcttggccagagttccgggctgcggttcctgggaattttgggatgagaagagagattcgaatcctgtctcggtgcctcgagactgacatttgtcaaaggggccaaagatagtaaatcctgtagtagaattcacggagatcactggctcgtagcagcgttctgcctcttagtgcacgggtgatgggggttgacttcatgtatgctcctgcagtcttgtggtgcccattcatccctaaactcaagtcacaagtccagcaggcaccctgcctccagtcagtcattcttgcagtgtattcatttattaattcatttgttccattgctaaaattgcatcgtcggatttgggatttagggaaacttcaaagaaaaaattttattaagcagaattcctgccctggtggagggcccctcaccccaggaccacagagcaggggtcccttagacgagcccagtctccagcagctggtacttctgtgatgaaatatttttccatgtgggttttcttttttctttttttgattttgatttttcaatcaaaagtggctttgtgatgttatttatttatttattttttaaattatgctttaagttctgggttacatgtgcagaacgtgcagttttgttacataggtatacatgtgccctggtggtttgctgcacccatcaacctgtcacctacattaggtatttctcctaatgttatccctcccctagccccctaccccccaacaggccccagtgtgagatgttcccttctctgtgtccatgtgttgtcattgttcaactcccacttatgagtgacaacatgcggtgtttggttttctgatcttgtgatagtttgctgagaatgatggtttccagcttcatccatgtccctacaaagcacatgaactcacccttttttatggctgcatagtattccatggtgtatatgtgccacattttcttaatccagtctatcattgatggacatttgggttggttccaagtctttgctattgtgaatagtgccgcaataaacatacatgtgcatgtgtctttattgtagaatgatttataatcctttgggtatatgcccagtaatgggattgctgggtcaaatggtatttccagttctagatccttgaggaattgccacactatcttccacaatggttgaactaatttacactcccaccaacagtgtaaaagcattcctatttttccacaacctctccagcatctgttgtttcctgacttttcaatgatagccattctaactggcgtgagatctcattgtggttttgatttgcatttctctaatgaccagtgatgatgagcattttttcatatgtctgctagctgcataaatgtcttcttttgagaagtgtctgctcatatcctttgcccattttttgatggggttgtttgtttttttcttgtaaatttgtttaagttctttgtagattctggatattagccctttgtcagatggatagattgcaaaaattttctcccattctggaggtcgcctgttcactctgatgatagcttcttttgctgtgcagaagctctttagtttacttagatcccatttgtcaattttggcttttgttgcaattgcttttggtgttttagacatgaagtctttgcccatgcctatgtcctaaatggtattgcccaggttttcttctaggacttttatggtcctaggtcttatgtttaagtttttgatccatcttgagctcagttttgtaaaaggtgtaaggaaagagtccagtttcagttttctgcaaatggctagccagttttctgaacaccatttattaaatagggaatattttccccattgcttgtgtgtgtcaggtttgtcaaagatcagatggttgtagctgtgtggtgttatttctgaggcctccgttctgttccattggtctatatatctgttttggtaccagtaccatactgttttggttactgtagccttgtagtatagtttgaagtcaggtagcgtgatgcctccagctttgttcttcttgggttttctttctgctgttaattccagaagtacattaaggacctggagccaggtttaatatcttgagatggtacagcaatctagtattttttttttgagatggagtcttgctctgttgcccaggctggagtgcagtggcacaatctccactcactgtaacctctgcctcccaggttcaagcgattctcctgcctcagcctcccgagtagctgggattacaggcatgcaccaccacgccaggctaatttttgtatttttagtagagacggagtttctccatgttggccaggctggtcttgaactcctgacctcaggtgatccacccacctcggcctcccaaagtgctgggattacaggcgtgagccaccttgcctggctcagcaatctgcacaacataaatctttatctaaaggcaattaaaaattcttctgttcgcagtgtatgtttccagcatttcctcttgtgatgtataggaaaatgagaaaaagccacctagtgaaaaaaaaaaagtaaatgtaaatgggaggaaaaaagcaacccccaaaagtaaatacaagcatacgcaaatgaacctaactcttaatcaaaaccataacccacagggaaaagtattcttccagacaactttgaatacagtttcctggctgtgtcagtcttatcacagaggaagggctccatgtgcacagccttcattattcaattttattttctttttgtcaagagttctgaatgcttcctgtttcttttaatcaggattttgacatttacctgaagccagatttctccaggacaagggcagcaaactgttagcaaacaactcggactgtttttaaatcagttttttgttgggaattgcctctgaatacaagtcagaactcacaagaaggtggctggagcagtctcactcttctccctggtcccttcacttctccattccctggagtagtccgggccacttgtttctggctgctgaaggccatacttgtcactatccctttcctaggatcctactctgaactctgtcttttcatatcaaagtggttgttgagaagtcatgatttgtggctgcttctacttgcagctgtctgtcctattggccctactacggctctaaaaccccacattatactcctctcctggaaaaagcatagaaatgggactgttcacagtgctattagcagctattaatagcctgattgaccagatgaatgagtcacttagcaagtgtctaagggaatgagacattaccagaggggtaatgaagcataggtcccttttggtggacaggggaaggggatggaggaaaaggtcccggagattttctggagacccagggcacagtgcagttggcatggataatagaggagaaggaagagagtgcaaaggggatgccaaaaggaaaaagggaaaaccctgaagaaactcaccctgtttacagtgttactgagaacgttccctttcctttacatcttttagagtatgcactgccctttctctgttagagagtctcaacgtgttcccaaggcagggtacccagaacatagcagttttgttgagataatagtaaagatatcaattaacctcacacaggtctttttttttttaattactttaagttctgggatacatgtgcagaacttgcaggtttgttacataggtatacatgtgccatgatggtttgctgcacctatcaacctgtcatctaggttttaagccccgcatgcattaggtatttgtcctaatgctctccctccccttgccccccaccctctgacaggctccggtgtgtgatgttcccctccctgtgtccatgtcacacagctcttaataaataactgattctctgtcctatccaggcgcttgcccttgtaacatttttttttgaggtttcaatattttattcaagttttttttaagtgatgttaattacagcatttgaaggggaggatctaattccacacaaaatggaagactctaaaatgtacccattaaactgctaaaaaacaaatcgagtggtgagaacacaacagaagtccaatttagattctgagtgttgtaaccatatgattacaatcacacagacacttccatgcttatagatggagctcctggaatctatttcatactctggtgcaagggcaaaaaaaaaaaacaaacacaacacaagaaggaataagtcctgaattattggcttcatcacatccaccttctccaccccaaaatggcacaaaagaaacagtgaccccaccctgcagaccttttggtgtaaaagaggtgatgatgaactggggtgggaacaggtcatggagatctgtctaaaaaagtcccattcaggtgagtttgtacacaacatcaagaagcgagcctctcctcaattagggttaggaaaccaaggttcaattctcaggaaatcaaaatttcattcatttactcaatatgaatttacaaagtgcctacatattatcagcttccacttgcagccatttctagataaaaaagaaacctggcatctcaaagtggccaccaagttccccccgagtctaccactgaaaggactttttttggaaatgggtttcttctgtacctccggaagggtaacatcttaaagctgaatcaactttaacctggagggctaacatatttagcaatacttgcatccaagacatacaacattaaaagatacactaaattctgaaagtagctatgctgcaaaatagtttaaaattaaacaattgtacagtattcatttatgcttgaaattccagtcctagaccaagcttgtggccaccagcattgacgttcttcccatccagaagagctgacagtgtcagtttgatacctggctttagagtctgagtgtatcctaaacctatcaggctggagttgttcactttagctgagaagcaggcgtcagggtcaatctgatacttggctgctattccaaagcgcgtgttactgtttcctgctgtccaggcaagattgacagcggtctccaacttcttgttcactttctggtaaatgaggctgccaaactctgtcccgtcattcacattagtgtgaagccagaattcatcagtctcgtagccaactgcaaagttgctctgggtcactctggactttgcagtctcaaaattcatctggtagccggccagccagcccttgtaacccagcaccagagcaccccggatggaaggcccagcaatgtcaaaatctatgtcgcagtccaagttaatgtgctcctgcttgtaccctgtcttgattttagcattttccccccccagtgttaggtgagaaggatgaatcgaaggtcagcttcagtccacatgcaagctgatcttccactgtaatctcggtgcctagtgtattgtcggtgttccatttctccgtaaacgtcaggccatactcagtccatctgtacttggtttccagactgcctgtcactttggtggtctcagtgttggctgagcctgagcttgtaaattccaatccattctcagattttgttttcaaatcaagctttattaagccaaatccatagtccttggtgaagacatccctggcagatttgccaagatcggcatacgtgggtggcacagccgtcttctgctcagagacggtggcggcgggctcagaggtggctacagcgggcccttgcaacatttctatgctgcctgtgatatctgttgaagtacacttttcaaaatgtcacaagcgtggccctgatacaaatatggagtgaacatatatcacaaggtgcattctctggcaactgttgctgagatgaggtttgttggcaagactttgcttatttatttagagacagggtctcgctatgttgcccaggtcagagtgcagtggcacaatcttggcttactgcagcctccaactcctgggctcaagtggtccccctgcttcagcccccaagtagctgggactataggtgtgcaccaccacagctggctaatttttttttttcttttttgagacagggccttgctctgttatccaggcaggagtgcaatgacatgatggctaattaattttttttttttttttgcagagatgggtgtctctctatgttgcccaagctggtcttgaactcctggcctcaggcgatccttccaccttggcctcccaaagctctgggattacaagtgtgagccactgagcctgacaagacctttagtaagcatcagccctgtaaaagggaggggacagaagtataactgggcagaggaacaaacggaactacaatggagagcccaacaaagccctggccatctaatctggacaggagttctggagtaagtgtcttagcttgggctactggaacacattaactatagactgggaggctcaaacacaaagtatttatttctccctgttctggaggctggaagtccaaaatcagggtggtagtatggctgggttctggtgagggccctcttccggttgcagacatgcctacttcatgttgtgtccctgcatggtggaaagagagctagctagttctctggctctaatcctattggcaggcactaatcctattagcagagtcctcatgacctcatgacctctcagaggccacacctcctaacactatcacattgggattagggtttccacaagtgaatttcggtggagtggggagtgtaggggaacaaacattcagtccattgcagtgagtactgttcacctgagtgtcttgtgttgggccaagatggccggccctgtattcccccgtggcctcactgagtcactgcttgtgggccatcctaggaagtatgtgacctcagcccaggcagctctctgaagctgaggcagtccctgaaagaacttgaaggggccctgggtggtacgggtttatgtttgcatggtctattcctctaaaattctggtgggctgctgttctttcaggttaacttaatgagggcaactagtgggatgaatcataacccttgccattggagctggtcttagacaactgcactaggaaaagaaaaatatccagacttttcaaggactgttggacacagggtctgagttgacactgatatctagagacgcaaagtgtcattgtggcccctctgttagagtggcgtgtacaaaagccagataataagtagagtcctggcccaagtccaccttatagtgggactttatggtgcttacactggggcaatggggccaaggccccagctggttgtcattttactggtctttgaatgtataattgggattgacataattggtagttagcgtaactcctacatttgtttcttggcctgtggggtaagagctggatgtggggaaggctaagtggaaacctctggaactgcctgtgttggttttctggggctgccataacaaagtattacaaactgggtggcttaaataacagaagttcatcatcttacagttctggaggccagaagtccaaaatcaaggtgttgtcagggttgattccttctgagggctatgagggagaatctgttccttgcctcttccctagcttctggcggtttgctgccaatctttggctttccttggcttgtaaaagcatctctccaatttctgccttcatcttcacgtggcgtgtgtgtgtgtgtgtgtgtgtgtgtgtgtgtgtgtctatgtgtctgtgtgtctgtgcccaaatttccctttaagaacatcagtcatattggattaggggcccacctgctttagtatgatctcatcctaacttaactaatttacatctgtaatgcctttatttccatataagattactttctgaagtagtgggggttaggactccaacatctgaattgcagtggggtggaggaacactattcaacccataacactacccaccactcagcagaggatcaaaagcaattttggatcctgggggtatggctgagattagcaccacctttaagaatctagaagatgcagggatggtgagtctcatcgtgtctccatctaatttgtcagtctggctccttcagaaactggctggatcctgaaggttgacagaggactgccacagttcaaccaaataacagcagccccagtggcagccagatgttgtatcatttctagagaagcttaacctggcctcaggtcgatggtatgtggccctcaatttgtcgaatgcatgcttttctatccctatcagaaaataagatcaaaaacagtttacaatcacacaaaatgggagacaatattcatttatagttttgtcccaaaggtattttaactctcctgccttctgtcataattagtaaaagggaatctggacagtctggataccccacagaacatcacatcaagtcatgatatcgattacattatgtaagagggggccagcacaatgaaggacttggtaagagacatgggctccagagggtaggagatgaacactgaaaattcaggaaactgccacgtgcctacaaatgttaggagttcagtggtctggagttcagtcctagaacgttccctccaaagtaaaggacaagccaggcacggtaactcatgcctgtaatcccagcagtttggaaggccaaaggagacagatcgcttgaggtcaggagatcaagaccagactggccaacatggtgaaatcccgtagccgagcgtggtggtgcagacctgtaatcccagctacttgggaggctgagggaggagaatcgcttgaactcaggaagcagaggttgcagtgagctgagattgcaccactgcactccagcctgggcaacagagtgagactctgtctcaaaatgagaaccaaaaaaaacaaaaaaatccacaaagtaaaggacagatgattgcatcttgcatctcccaccatgaaggagggacaatgcctggtgggcttcatcagattctgcaggcagcatatttgacacctgggaatattgcttataccacatgatatagaaggctaccagttttgaatggaacccagagcaggaaagggcctcatagcaggttcaggatgcagttcaaacagctctgctgcttgggccatgtgacctggcaaccactagagtgttggaagtatcagtggtgggaaaagatggtatagaatttgtagtaagccccagtgggcatatccaagcttagacttctgaggttctggagcaggcctatgacatgtacagtggagaattatacatttttaaaaaattggccctgggcagcgcatggtggctcatgcgtgtaataccagtactttgggaggccgaggttgcagtgagccatgatcattccactgcactctagcctgggcaacatagctagacaatgtgtgaattgttttttttaaaaaaggcccaggcaaatcctgacacaggctacaacatggatgaacgtggaggacattatgctaagcgaaataagccagtcacaaaagaacagatactatataattccacatattgtgaggtacctagagtagtcaaaatcatagcgacaaagccaaatgggggatgccaggggctgaggggagtggggaatggggagttgtttaatgagtgtagaatttcagttatgcagctggtgcagtggctcacgcctgtaatcccaatactttgggaggctgaagcgagtggattgcttgagcctgggagttcaagaccaatctgggcaatatgtcaaaaccttttctctatcaaaaatacaaaaaattagctgggtgtggtggcgcagtcctgtggtcccagctacttgggaggctgaggtaggaggatcacttaagtttgggaggcaggcggaggttgcagtgagccgagatcataccactgcactccagcctgggcgacagagtgagatcccatctcaaaaaaaaagaaaaaagaaaagaaaagaaaagaatttcagttatgcaagatgaaaaggttctggagatctgtttcacagcaatgcgaatcgagttaacaccactggaccatagacttggaaatggttaagttggtaacaaagaagagactcagaatctcacaaataaaaatggtgaacattgtttcatatatatatatatggccctgatgtgttactgggctgtggtagagatggaatgcttggccatggagcactgagacatcatgcacctggagctgccggtcatgagctgggattctgaatgcaaataaggaggccctctggtgttcacatctggctttcagtcatttgtcacagtccagttgtctgaataacattaactttttgtaaagcatcagtggcacttgtaatagccatccaatgcttttatccttagatcctttcatctactgtttcccccatatatctctaacgcctgatacatcttgttcaatcatgcattctttcccacctgtatagtctcccaactcacaaacagtgaaagctttaacagccaaacccctattttgtaccaggggctgtctgtgctccatctgccaccaaggatggggtcctcattgccagctgatggtgaatgatccagctccaaatgcccatcttatctcttactcttccttccttccttcctctttctctctctctctctcatttggagtctcactctgtcacccaggctggagtgcagtggtgcaatctcggctcactgctacctccaccttccaggttcaagcgattctcctgcctcagcctcccaagtagctgggactataggcgcatgccaccacacctggttaattttttgtatttttagtaaaacgaggtttcaccatgttagccaggatggtctcgatctcctgacctcgtgatctacccaccttggcctctcaagctgctgagattacaggcgtgagccactgtgcctggccatctcttactttcttagactcctcccagtattatctatcacagggtgggttttcctgagtcagttgctgagatggagttttgggtacaagattggggatcaattgatatgaaaggaaggggtgaataaacaggatcaggcagagggagagctgagtgggatgcaggccacacaaagccttggccaacccagtggggagctctggagcagggacagcgcagtagagtgtcccctgttttggggaaagggcatgaccttcgagaggtagctttttgcagctggagcgaaccctgatggagctgacaactggaggctgcctgcccactgcactccctgcagctgcacagtgagtctttccttgaaaggtggtctgggtggtgcatctctatgtttacctcaaagtgtcaaatattttattcaacttatcgttgaggaaacagcagtatgctaatgctggttccgagagcatttgaggacctggatttatataatcctttataaaaaagaatattagattaatactgttaggttaggtacaaaacagattaatgtgtcacagggcaatgaaaccatatcctttggagttatctttctgacagaacaaaaatcatttgtttctctactggacaaacatctgcaagttaatagaaaacttcacagagtctaggcttttgatcaatagtagacagtgtatcaaagaaaggcacattctacttacagaattcagtagttcctgggcgagcctgttaaacaatgctccaatatgacattaaaaagacatgctgttgcttgagcccaggagtttgaggttatagtgagctatgatcatacaattgccctccagcctggacaacagcacgagactccatctctaaataaataaataaagaagacacactgatctccacttgctctatttccaagtttttggatacattttcttatcatctctaaggcagagcatcccccctctggtgctgaacaaccagcctcttccccctcaccttttacatttgtccttggaattggatcttcgttttgtcaggaactggttactgccttccaggagctttgaagagttgaatacaattgctgcccatggtttccttgtctccttttcttaaaatttagcaatcacattgaagctaagcctcctttctagtgattgcaacttactgtttttatcagaaagcttctattttccaaggcaaaaatggtggctaaggtagaccctcagatggacccctacttctccttagtcagaaagtaatctttttggaaatctgaagaaatttcttgtatagctcctttatcatcctttatcctctgaaaagtcatactatagtcttgcccatagaacagcccttcgtgaatccttacttatgttatgtctaattctccaaacaccgcccccttttttttttttaaactagacggagtctcactctgtcacccaggctggagtgcagtggcccaatctcggctcactgcaacctccacctcctgcttcaagcaattctcgtgcctcagcctcccgagtagctgggattacaggcacacgtcaccacgtctggctaatttttgtatttttttgtagagatggggtttcaccatgttggccaggctggtcttgaactcctgacctcaggtgatctacccacctcagcctcccgaaatgttgggattactggcgtgagccacggtgcctggcctgaacaccttttgcatttgtcatcatctaagtctttatgtttcttcctatcaatatcttcttaccactttatcccctacacccattctccgtatccgtgcaaatgctcctcatccatcaagtttcagtttcatctcctccatgagtaacacttccctaaggacattgtgtcctttacaatttttttatagctttattgaggtacatttattgacatacaatacatggcacacatttaaactgtacaatttggtaagttttgacatatgtttacattatgaaaccatcaccacaatcaatatagtgaacatattcatcacccctgaaagtgtcctcatgcccttttgtcatccctccttctgggtcctccctgccaccacctcctcagaaaatcagagatctgctatctgtcagtataggtattttgcattttctataatttatataaatggaatcatatagtatgcattcttttttgtctttttttactcatattactgtaagattcatccaaattgttgcgtgtttcaataggtcatttattttcattgctgagtagtattttattgtgtagatataacacaatttatctatttaactattgatgaacatttgggttgtttccagctgtgggctattacaaataaagctgctctgaacatttgtgtacaagtctttgtgtggacttatactatcatttctttggggtaaatacctaggagtggaatggctgggttatatgtatatgtttaactttgtaagaagttgccaaataattttccaaagtggttgtatcttacattcttaccagtggtgtataagggttccagtttcttcacatcctcatcagcacatagtatggtcagcttttaaaaaattttagccattctaataggtgtgcgcctgtagaatggtacctcattgtggttttattttgcgtttccctgatgactaataatgttgagcatctttttatgtgcttctttgccaattgagtgtctcctttggtgaagtgtctgttcaaattctttgcctatattttttggttgcttgttttctcatctttcagttttaagcgttctttataaattctggataaaagtcctttatcagatatatgctttgcaaatattttctccttgtctgcggcttgtcagtttattctcctgtgtcttttgaaaagcagaaacgttttagttttgattaagtcaaatttattaatttgttcttttcgacttgttcttttgctgtcatgtctaagaaaacttttcctaatccaacatcacaaaggttttgtcctacaagttttatagtttgaggttttatgtttaggtctatgatccatttgaggtaattatgcacatggtagaaagtatggcttgaggttctttgttctttttttcacatatggatatccaattgttttattaccatttatttgttgagattatcctttctctactgtgtttcttttgtgcctttgtaaaatatcagtgatctatatctgtgtaggtttatttcttgactgtattctgtttcgttggtctatttgtctaccttgatgtcaaaactacactcttttaattactataactttaagttatgggtggaatggctccccaaagatatccatgctgtaatctctgaaacctgtgaatttgttgtgttacattggcaaaaatgactttttaaaaaatttatttattttacttatttattttttgagacagagtctcattatgttgcccaagctggagggcagtggcgcaatctcagctcactgcaggctcgaccttctaggctcaggtgatcctcccatctcagcctctcaagtagctgggactacaggcacgtgccaccacccctggctactttttttatttttttgtacagatggagtctcgctatgtttcccaggttggtctcaaactcctgggctcaggcaatcctcccactttggcttcccaaagtgctgggattacaggcctgagccactgcaccttgctggcaagaaggactttgcagatgtaaataaagttacggactttaaaatagggaaattatcttggattatttgggtgtgcctaatctaatcacacgaacccttaaagcagatagctttctgcagctgaagtcagaaagataaggcgatagagtcaggtaggagagatgcagcagagaggtgcgagaaatcagagagatcccaagagtaagaaggattccacacactgttgctgtctctgcgatggaggagtccacagaaaggaccaaagaggactctaggagcaaagagtggcttccagctgacagccagcaaggcaacaagaacctcatttctgtaactgcaaggaactaaattccgtcaacatcctgaataaccctggaagtggattacccaactgaactactgacttacaggaactgtgacttaataaatttgtgttgttttaaaggtctgtgataatttgttatggcagcaatacaaattaatatgctttatcatgtcttgaagtcaggtagtgttagcccacctttttcctctttttcaaagctgtgttggctgttttcaaatttattggtgtaaagtttacaatattcccttgaatcaccttttaatataattttaatatcataatacacccctagttattcttttaatagaattagtagtgatgttacctctctcattcctaatattgaccatttacactgttccatctggtaattctttgtcaactctgtaaagcaaaactaaaattctaagccccccacccatctgaatggaccccttctctcagctaagtgtattccaaagttaacctgaaaaactagtttaggtcatgatgggaaggaggagtagggcatgccccattatgccctcctcccttttagaattctggcacagctgaccagtattaacattaacacagaccttaaggctgacaaagcagactctttgtaataagaagatatcaaattccatcctgactctagtacagcatcacacgacagatagcatgccctgaaataaatcaaagtattttacccgaaatcatgtttatttgccatatctttgtcctgcaaagctgtcttttatggggaaaatgtacactctgaagagaatccccttccttttccaggccttttccctgatccaggagagaaccaactctggtaagaaacatttacaatctattctctctgaagcctgctacctggaggcttcattggcataatgggaaccttggtctccacaactccccctttacccagacactcctttctattgattctgtctgcataatggaagccccagtgtccacaaccccttatcttaacccagacattcccttctgttgattctaggtctttagacaataacttaactctttcaaccaattgccaatcagaaaatctttgactctatctgtaacatggaaggacctccacacttggaattgtcctgtcttttctgaccgaaccaatgtacatcttacatgtactgattgatgtcttatgtctctctaaaatatatataaccaaactgtaccccaaccaccgtgggcacatgttctcaggatctcctgagggctgtgtcacagacaattggtcacttatatttggctctgaatacatattttcaaatactttacagagtgtgactcttttcatcaacaacactcatctcatctctgaatcactccaaagaaggggctccacaaccacttctgttaacttgccagtggactagttctgtagctgtcgcaggattcctgggtgttgcttttctggctggaaacctctgtggccagtggcgcctttgcccaagttttgctcaggcccgctgggctggttccacccactcagcctggcaggctgtgctttgctcatgctattgccctggaccccacacctgccaagggcaagccaggcatggaacagtgaggggtgtgtgagcaagtgagcagggggtccagccactgcacacagtcaagcatgttggctgctgcagtgggacaggcagctccaggtgccagcatggatgctggctcactgcgaggctgcagctggaccaggcacaccacaagcagcttccatggctggcactggggaacagtggtgcctggaaacttggagactctaggaaccacaggacctcaaagaggaagtcacagccctggctcagggagcacccacatctgggttccctgaagggctgcagctcttctttccttctttgcctgcaacgtggcaagcaagaggtgtgtttcagccctgtttgtgttacaactctttcagctctgccgttcggcagctcccgagttcttgtcttgtgtccaggaagaatgaagtacatggacaaatggacaatgagcaaggtgaagaggagctttactgagtgactgaatagctcagaggaaaccctggaatgggtagctcctctctgaaggcaggtcatctttcagatgagagtgttcagctctcagcagcaaggaagccctgaaatgggtagctcttctttacaggcacattatggtgatgtctcccagagtctggctgagtccagggttctcatgggcctcagaggggaggaagtgtgtgctgattggtccatgggcagccatggctgggcccaggaaaaacatcaccagttccccctccggtcagcaggactggaggcctggcttccaggcttcaggccttccccagcctgaaggtagggcttcaccggggacccactactttctaccccagagcctgtctcttatggctttctatggtgcccaatttgtttgtgccaaggagtgcctgcaggccagtgtggagctgccctcagcaccccctcggcctccctcctgtgctggtcagtgcccaaagtctggagagggctgaggcagcagggggctggcatgtcagcactgcctagagtgcgcacacacacggccaggctgtgatagcacctgggcttggccccaaccttgctctgagattggagtgggcgctgggagtgtggagaagccaggcagaaggagcagacccctctgagcctgtggggggacgggggtcttcctgggaccctgagagtgcagatatgcccaggtctgcagctgtggcttggatggttgcagctatgtccaggagggtggggctcccgcctgctcctagcccccaagagcacagggaagcctgggtctggagccatggcagggcagctgcagcagctccctccccaccaacttggaaggggtgcagctcctgcttgtccctggctcccaccagctccctgtaacttgcagccctgtgcctcccggctgtagccagcaccttggcagcagctgctccagatgggttgctgctgccatcatagtcgctctggttcatctggctctctctgatagtcttagcacctggagtgtaaatagaacaaccttgtcctgcttatgcttcctaaaatcctaggctccttcatcttcttatgccagctgaagtatgggctcccttaaagcaggaaatagtgttgaggtcccttctttttcttacatccctcttggtgcagtgtactgccgacctggggacacaataggtatatgatgtataagtgaggattggttctttcctcctatagtaaacatttatgtttttgacctgattccattaatgtccaagttgagctttctgtttcagagcacatccaattattcatgaatatttatagacattacctttaatcacatgagaacatcctagttaggacaagctgccctcagagaaaattacaggggcatgtgggttctcttccctatggtggtgggtagtggagccagacccaggattccttctctttctcctgcccatcatctcaagacacttaatatgaggctgcatgatcacttctttgtgttcgaagatgtcaaatttctttcagacactcacctgcatcttctttggggacatgggctgtaagagcacaggatttaaagaatccttaaggttgtttgaaaatagttcttggggctgggcatggtggctcacgcctgtaatcccagcactttgggaggccaaggtgggcggatcacttgaggccaggagttctagaccagcctggccaacatggtgaaaccccatctctactaaaaatacaaaaattagctagcacagtggcgtgtgcctgtaatcccagctacttggaaggttgagggatgagaattgcttgagcctgggagaaggaggttgcagtgagctgatattgcaccactgtactccggcctgggtgacatagtgagactctgtctcaaaaaaaaaaaaaaaagaaaaagaaaaagaaagagagaggaaagaaagaagaaagaaagaaaataagaaagaaagaaagaaagaaaatagctctggaacctcagtttggctacagaattggttatgtgacattgagcaagctttatacatcatatatgcctcagtttcctcatttgttgagtgagatatctagactagggaaatcttaaagctaacagccttcagttcccgtgttttatcttccaacatcagcaacaaaaacaggaagcctcagtaccctgatatttgcagagtttctggcctgagcccccatggcttctggctgagccatccaaggattttggttctctctcaaacagcttcatcttccaccagattttaatctgaatgcccaataaagtcaaatagagttggcctctgaaatgaaaatactgttacaagtgggagagaaactggagggtgagtactgctagaacatgagaaatctctcttgtgggattccccctgcacagttattaaagttttgaagggtaccagaatatgccactccaaaatatgcctctttggtatatacattattttgtgctaaagaccattgataaccagcagatgcaggaaaagctctttacttccccctaactgcctaaaaataggcatttatgaagtggcatgtctgtggaaacaaaagaaaaacaaaagttaatggttagaaaaactttacacccagatttttagtccagagggcagtcattcaaggcttttaggtgctggaccggaagcatctttagatgatagagtgggagtaggcagtggcaatccactgattttcctgatttgcagtgtcacagtcatggttttttctcagagcagagcatgaatggatccagcttcagcttgcagggctttttagatagtcccaataaggacccgggcagtcagatcttagttttcagtggcatcaagtcagagggggtgagagaataattagaaatgttaattactgacaaaaagcacagaacagcaggatccagtttacaaagaggtaaaaagacaaaacaaaacaaaatgttcaaagatagtgaacatggctagaatttgacaacccacaagggtgtgctatagtttctcacaggaacagaatttttctttctataatcactctcatttctatcaaagatcatcaaaggaagactcatttgcttacaaggtaagtcttgtctcattaaacttggcctgataagtgcataagtgcagcaagaatagtgactgatcatatagactcttttaagtctgctttgctggatcttttaataaggaatctcaaattagtctttcattgattgattgattgattgaggtaaggtctcactctgtcacccaggctggagtgcagtggtgcaatcttggctcactgcaacctccgcctcctgggctcaagtgattctcccacctcagcctccagagtagctgggaccacaggcatgtgccaccatacccagcttatttatgtatttttgtagagatgggttttgtcatgttgcccaggctggtcttgaattcttgagctcaagcgatctgctggccttggcttcccaaagtgctgggattacaggtgtgtggcaccaaatatatatacatatttggagacagatgttcactcttgttgcctaggctggagtgcaatggcacgatctcagctcactgcaacctccgcctcccaggttcaagcgaccctcctgcctcagcctcctgagtagctgggattacaggcatgtgccaccatgtcccgttaattttgtatttttagtagagatggggtttcaccatgttggccaggctggtctcaaacacctgacctcaggtgatccaccccccttgacctcccaaagtgctgggattacatgcatgagccaccaatatacttgccaatatattggcaaattttccaatatattttaagattcttggacctgtcaggaagtggccttccttattcatctgtaagaagagggatcctgtaagacaggtaccaagccggtgttccaagagggctttgtaagcattggctccataaagtcaaccttagttccttacatctgtttggtcttatctgattctatgttccttattcttaaatatgacattccattcaaatccttggtaagataaccagtgtttctaattttgtcctgttttaagaacagattcttattgaacttatgcaaataactatattaccatgtatcctgttacagaaaagatccttactgaagatatgcaaataacaatattaccacgaaaataatatttaataagagtttctgaattctggaaggatgagatagggagaaaaataaatattttattttcatttacaaaggtataatctaacaaattgttgtaagttataaatagtttaagagaaaagagaaaaagcgttttcttaaatctggaaaataaaacactaaagaacctacaatgtttcaaaaagaaagtcataaaaattataatcatcttcatcagtttattcagggccatgtaattaatttttgtcctgcttgatcttgggttagcagctttataaagtcatgagaattttgttttttttttaaacctgagttctgggaatttttactcagtttttttttttttttttttttttaatggagtcttgctctgtcgcccatgctagagtggagtggcacattcttggctcactgcaacctcgcctcctgggttcaagcgattctcttgcctcagcctccggagcagctgggattacaggcgcccgccaccatgcccggataatttctgtagttttagtagagacagggtttcaccatgttggccagcctggtctcgaactcctggcctcaagtgatctgcccgcctcggccttccaaagtgctgggataagaggtgtgagctacagtgcctggccaagttcagtggtatgatcttaaggttattggaaacccgtactttggaatactcgtcagagtcttttgtttgaatccttttgaagatggagcacttttgttttttgcttacaggtgattgtaaaagctatcagataaaaaccaaaataataattgcctgtgaatgacaaaatacttaaaatagccatggttaaagatctaactaattataatgcaattgatgatgaaatttggttatttctgtgacataagatattttaacataatatctggaattatgttaaattatgttaaatccataatatctggaataccagaacatatagacagtaaagacattgacaaatttttaggaatattatacaatttctgaaacacatacatatatatgttttaatttttcatagagacgtaggtcttactacgtggcccaggctggttgaactcctggcctcaagacaagatcctcttgtctgggcctcccaaagtgttggaattataggccaccatgcctggcctgaaacacttatattaataacatagatatttacaaatataacctaaagaaggttaagcatcagttcacatttcacaatgattcccatataatttaacatatcaaatacatctaattagtttagcatctctcttttacaaggtgatagagagaacaagtcctttgagattttacaggggccctctgggaaatctcagttagtttgaggcaaaaaaggatttcatttagaatttcatttggggaagtttgtaaaaaaaatgtcaaaaggtttgaacacctgattatataagatcaagaacactatgagacaatacttagttatctatttaaaacaaaatgacaataaaagatttcaaaggcaaatatagaaagtaacgtatgtataaaaaattgcttagctctttcaatactgagaaaattccatttcattaagtaatcaaaggcttgataaagacaatatgaagcacagaaaattatttttaaaattttttattgatacataataagtgcacatatttagggggtacaggtgatattttgatacatgcatacttagttcaagtcagggtacttaggacacttatcatgtcaaacatttatcatttctttgtgttaggaatatttcaaatcttctcttctagcctttttttttttcttaacacagggtcttgatctgttgcccagtctggagtgcaatggtgccatcatggctcactgcagcttcggctgcccaggctcaagtgatcctcccatctcagcctcctgagtagttgggaccacaggcatatgccaccatgcctagctaactttttaaattatttgtagagatgaggtctcgctatattgcccaggctggtcttgaactcctgggctcaagtgatcctcccacatcagccttctaaagtgctgggattataagcatgagccaccatgcctggccacttctagctgcttttgaaatatacaataaattgttaactatagtcaccctactgtgtattcaaacactaaaacttgttccttttatctaattgtatgtttgaaattatttgaaaagacacagaatctttgttttcttttttttttgttttttttttttaattatactttaagttttagggtacatgtgcacattgtgcaggttagttacatatgtatacatgtgccatgctggtgcgctgcacccactatctcatcatctagcattaggtacatctcccagtgctatccctcccccctccccccaccccacaacagtccccagagtgtgatattccccttcctctgtccatgtgatctcattgttcagttcccacctatgagtgagaatatgcggtgtttggttttttgttcttgcaatagtttactgagaatgatgatttccaatttcatccatgtccctacaaaggacatgaactcatcattttttatggctgcatagtattccatggtgtacatgtgccacattttcttaatccagtctatcattgtttttgttttctattacttactcaataggtaaagaaaacccccttacaataatccaatttttttcattttaacagagagagaaattcaaattatagttttgcataggtacattactgatattaaatctcattttaaaaactgttataataaactcattcaattaaaatagacgacaatttaattgtcgctaaaatgacaggttaaggcctgtttgaccacaggagataagattctctctctgtgtgtctctcagtctctttctttacattttatatctatttcagtttttgtcctttattttcccctttctcattttgaaacaaaatttaaataacccctcaactagaacaaaattactctccttttcccttaacaaaaatgcacccttcatacctcagaccttttcttaccaaagcacatcttattttccttgcacactttgcatatagaattttttcctttgtccttattatttctagtagttaaatatattgattagaattcttaacccttagcaatcttcattctcagttaaaattagaaagcaaggaagtgtaaactgtcacataccaacattttgtagtagattagcaaatttatggatacaccctttcataattcctagagatatatgcttccctgtagtataattttttgatgtggcaaaggatatttttagtaacaggtcccaatatctttagtatctctgtaaaaattaagaagccaaaattagatgaatttaaacttatgtttagcaattgatgttgcagtattttatattatttgttaatcatctagatatttaatgattatctatctatcatttaatgttacttagtatacttttagggcttcaaattaccaaaaagattttggaagcattttcaagcaaacattataaaacatgtaataggccgggcacggtggctcatgcctgtaatcccaagactttgggaggccgggtcgggcagatgacctgaggtcaggagttcaagaccagcctggacaacatggtgaaatcccatctctactaaaaatacaaaaaagtcagctgggcttggtggcgggcgcctatagtcccagctactcaggaggctgaggcaggagaatcgcttgaacccaggaggtgcaggttgcagtgatctgagatcgtgccactgcactccagcctgggtgacagagtgagactctgtctcaaaaattattaaataaataaataaataaaacatataatagttattgttggaaagttcatttataaacttttagcccatttccattcatttaattcacttgttattaacaattatgcatgaattgttcatgaaaatttcctgagacattaaacaaagctagccatcatcttatttttcttgctgaccaattttataacacatgtatattaggcaagcatcaaacattacagaacaaagcacctgaaaaattaaacacatggctccccaaatttgtttttactggtgtacttcatacacacaagcaatttatttatttatttatttttgagacaggtctcactctgttgctcaggctggagtgcaatggtgccatcatggctcactgcaacctcctcctcctgggctcaagtgatcctttcacctcaggctcccaagtaactagggctacaggtgcatgccaccacgcctggctaatttttgtagtttttgtagagagggggtttcaccatgttgcccaggctggccttgaacttctagcctcaagtgatcctcctgccccacccaccagcaatttgtttttattgtacatttggtttttagcttaaatttataatttttaactcttaaacacctagtacagataatgtaacattatttaacttgtaaacccaagagaataaaatcacgtctgtataatatttaatgctgtcaactgtgaagacaagctgtttttatttaaccaacagtctttttgtttcgttttactttgttttgtttttgaggcagcgtctcactctgttgtgcaggctggagtacagtggaacaattatggctcactgcagcctcaaccttcccgggctcaggtgatcctttcaccttagcctcccaccaccacgcctggctaatttttgtattttttgtattgacgggattttactaggttgcccaggctggtctcaaactgctgggctcaagcgatcctccctcctcagcctcccaaagtactgggtttataggttcgagccactgcacccagcctaaccaaaaatcttaactcagcaatcttaacctaactttatttaccaaagattatcccagattatgtgaattcgaaaaaaaaattggattggattctagttttctaagagttctaggaatacttaatttacataagtgcttaatttattttagaccaattaaagcagagctcttttacaggactttatgagttaattttgacagcactattgcaaggtagaaaataccacctatacataacatatatacatacatacatggacaaatgtacaaaggtacaggcaaatgcaaatagagatcttatagctttcatttaaaatttttagctatgaatcaggcaaacatagtaataaaaaactcactagtttatatacaatagtcagatccaaattgtgtttttggcagatgggcaaattaaggttacctgtttaatgagggctaattttactatttgtggaagagaattttgagactttcatttgcccatgataaataattttatgatgacaatagaccaagttttggttgaaggactctctggaaatgccaggtagcaatttgttttcaaaagcctctttctccctcttcagtctcaggtggttgcagatggtggctttagccaagaatgatctctttggatgttttatgctatctatctatctatctatctatctatctatctatctatctatctatgtatctatctatcatctatctgtctatctatctgtctatctatctatctatctatctatctatctatctatcatctatctattttttttttttgagacaagatctcactctgtcgcccaggctcgagtgcagtggtgcgatcttggctcactacagcctctatgctccaggctcaagcaatcctcccaccttagctccccaagtagctgggaccacaggtgcaccccaccatgcccggctaattttgcatttttttgtagagatggactttttgctatgttgcccaggctggtctcgatctcctgggctcaagggatcaatctgccttggcctctcaaagtgctgggatttcaaatgtgagccaccgcgtcaggcctgataaaaatatggtaagagttacaactccaagggacagagaaaggttgtaaattttctctgagaaggcacatttgcttactgttggaaacccagggcaattgttatttgtgttttttttaagtgcagatttctttgtggtgggggtccaaaatgcatccgcaaagggaattgtgtgggagtgcctggagctgatggttgtagagtaaggggcagtaaaacagccttgctgcgcatttttgggggtcagaggttgggtggctttgttaaagctagttgctggctatcagtgtttgtataagtcccacacctgcctgagtgtcttttgtaagtcttaacttttattctaagtctgatctctgcttcctaatcttgttaagggggtttttgctctcagaaatgcactctcccatttctttttttcttcttcccatctgatctttccacaggtaccaagaggatatttatttaggatgagagctctctaaagattattttagatgtcaaaccaaaggatctgtgtctggccatcagtggataggacctctgaaagatacacctactccgaatgtggcagaaaccataaagccttttgatggaaagacccagaggcaaatttccaggccgagagtaagtttttaccatggacaaaagagacatccctgaaatgggtgcagatgatgttgcccctgtgattccaaataggtcactcccaaagatagacatggaatatgaaggcattcattgtcacaggtggtaaggaaactccagtcttccacaaaagtgagacaccttcaatcacaaacccactaatctgtgacaccaggtaggcaatactgggacaggaatttccctagcacatgtaaggcagcaaagagaaaagacgcagactcagctctgagagttggcacagttgctaggcaaagtatcttgggtccccatcctgatagctcaccacctacagatgcaagcccaacaacctgcaacgccagcagaaaaaccagggggaatgtgctctcaatggatccaagccaagctctcaagacacaagataagatggaagaaaaatctcatctttttaaaaaattggtgacccacagcaaagttggttcaaatggagactggtccggtgagaactgtaaactcaccaatctgtgaggttgaacaacaggcttataggacatatgcctgcattttaccctatgattcttcctcttatgacaaatgacacaaaagacagagacaaaagaatattgtggctaccctttgagagagagatggatcagtaagaaatgatcaaagtcacacaaacccagagaactaacttcacacaaatgttttctcctgttaatctaaacttggaaaggagaaatttttaccacctggtcttgaccatagtctacacatggaaatctgggatgctgagttcaggaagaattcttaaccttttaccagtttggtctgggccccagagttttactgtagcctctggggtgagtcagggactttgttggttttgttctctgttgtatccctagcacctagaacagcactcaggcacatagcagattctcagaaaactctagttgaagaatggatgggagccaggcacattgcaaacatcactaagatgcacagatgtcctccaaggtgggcatttgaatgagactcagagaggacaggtgaattccccaaggtcgctgctatggtttgagtatttgtcctctccaaaatttatgttgaagtttaattcccaatttggtagtgtggagaggtaagacctttgaaaggttattgggtcatgaaggctctgccgtcatgaatggattaatgggttaatgaattaacgggttaccatgggagtgagactggtggccctataaaaagaggaaaagaaacctgaactagcacacttagcctccttgccatgtgatacctatctgcactgcctgaggactctcagagagtccccaccagtaagaccatcctaaccagatgtgccccctcaaccttgaacttagcctccagaactgtaagaaataaattgcctttctttataaatcacccggtctcaagtattctgttatagcaacacaaaaccactaagacaccaggcaagtggaacagcattgacttacccaagaagagatactgggctcaccaggtagcatcagtttagctaattaattatgaacagtcttggtgttgttcaggtatttagtgccagggatgtgctaactgcttttcaggtattttctaacttaattatcacaatatcttttgaggaggtgctggccccattatgacctctgttttacagataaagaaactggggcacagagatgatatgtgaccttgcttccaggtcactcaaccagtggataatgaattcaaggctcaaaccctgtctatctgtggcagaagccattgtcctgagggccttggttaatagtaagagctaactcttaatgggcagctgggctctgttacagacactttactgtgctaaatcatttcatctccacagcaacactgtcaggaaggtgcctttattttcccattttacagagagtgaaactgaggcacagagagtttaggcaacttactcaaagttaaatagttgggaaacggattaaaacactggaagtctttcggtgctttatgagttctttttttttagcagtatttaataaatataatttattgatatttaacaatacttaatggatttaataaacttattaatatttaacaatacttaataacattaatccattgtctagcccttgagtccaagaattattgctctaacaaaacaacaaggacaactaggccctcctacttccctgtagcctcaactagataaatgcaaatatgttggctcatgcctgtaatcccagcactttttttaaaaaattttattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacaacagtccccggagtgtgatgctttatgagttcttatggaggcttcattatgattaaaccattgaccattggtgatcgactcaatctctagtccctctctcctccttagaggttgcaggtggggaggaaagtcccaaccctctaatcctgccatagttttctggtgaccagcccatcctgaagctacctagcactctcagccaccagtcatattattagcatacagaagacacatcactccagagattccaagagtcttgtgttaggaaccggggactgagaccaaatattatagcaaaagatgcttctaccactcctatcactcaggaaattaaaagggttttagaagctctgtgccaggaactggagatgaagtctaaatatgcatttcctattatatcagaatatcatggttggttttcacctggtacagagggtacaaaaggtacagcaggtacagactctagcagtgaccatcatcagcatctcagaggagtggctggatctttctgctaacccactctccccaacaccctcacaaatttaacccttgattttgattttggtaacaaagtggagtcttctttttgtttgacagtttaataataattgtgttgaccaaaattaaggctgttgaggcataaataatttcataaaggtttattggaagtcaaatgtgaggattgacctgggaagacacaccaacaaaaagttggtgttaagagtctgttacaagttggaaggctttgataagaaagtttaggggaaaggagggggatttctcagttggagttgtccttcttcattggaggttacaatacagcggttacaatcattggctagagatgacaacatacaaggtaacaaaatttattattttttgggacagagacccgctctgtcacccaggctggagtgcagtggtgcaatctcggctcactgcaacctctgctttcagggttcaagtgattctcctgcctcagcccccagagtagctgggattacaggcgtgggccaccacaccctgctaatgttttgtattttttgtagagacagggtttcgccatgttggccaggctgcttttgaactcctgacctcaagtgatctgcccgccttggtctccccaagtgctaggattacaggtgtgagccaccacacctggccactaaaatgttttatgcacaagacaatccataaaactttatgatttagaaacaaatcagtgtccttttcaatgtcagtaggttatgtattaatgagtacatcaaacttgctcagaagctacatttaagcagaatcacctctaggtttgggcataagtgtacatctggttacagattacagaagcataatcactaactccttcagacattaccttatgtgtggggaaaggcaaggactgaggttacttatcttttaaggaaaatagtgactcagggaagagacatggtgggcctgtactctaacctgttttgtcttgagagcatctttctggcgagctgcacatcctcacagagtcaggggctttgtggaattatgctggcaagcagaaatgagcaaacatggattcttccacctgctacttcatctcacaattgtttgcaaatgtcattattgcactcttccaataatgttatctcaaaatttaagcatcattctgacacgccacatttttttttttttttgagacagggtgtggctctgttgcccaggctggagtgcagtggcgtgatcttggcttaccgcaacctctgcctcccgggttcaagcgattcttgggcctcagcctcctgagtagctgggattacgggcatgtgccatcactcctgtggctaaaatttttgtatttttagtagagacagggttttgccatgttgtccaggatggtctcgaaatcctgacctcaagtgatccacctgcctcagcttcccaaagtgttgagattacagacctgagccactgcctctggcccacttgtttacatgtatgtatgtgtattagagacaagatcttgttctgttgtccaggctggagtgcagtggtgagatcataggtcagtgtaacctccaactcctgagctcaagcagtcctcccaccttggccagagtgctgcgactacagcacctcggctattgttagatattatcaatcctgataggattgaagtatttattctaaacaacactcactttaatctgggtctagtatagccaatttagaggttaaggctctatttttaaaactggagtacataggacacactgcacgagtgtttggaactattgagactgtgactccaagggcctgttggtattttctgcaaggcccagtgctgtttgtgtggtctcacaccagaaggcaaagttacactctgaactgtctagcatcagacatcttgggccagcaggccaggggtcagcttctgtatatccttgtggaatgaatggcatgcaggtccctgtggaagtttctgtctctctctttctttctctgtctctctcactctctccaacacacagacacacacacacacacacacacacacgaacgcacgcacaaccagggatcaggggcttctggcaagcccctgtcattcaactatttctatgtgtgtttgtagagcatctgaaaattttctttttttctttctttttttttttgagacagagtcttgctcttgtcgcccaggttggagtagaatggtgccatcttggctcagtgcaacctccacctcccgggttcaagtgattctcctgcctcagcctcctgagtagctgggattacaggcgcctgccaccacacctggctaatttttgtatttctggtacagatgggcttttaccatgttggtcaggctggtctcaaactcctgacctcaggtgatctgcctgcctcggcctcccatagtgctgggattacaggcgtgagccactgtgcccagaccatctgacaattttcaaatgacttccacacatagcatcttatttcacccacaccataaccctcataagtatctaactgactatcctcattttagctttatggaaacagatgtggagatggaggactgtgtcataggcagaagtgactgagcctcagcctgaattcagggtgatctgttgtgggctctgttctctacgacacttggcctgtggcccccacacaggcctgtcttcctatatccctcctctgtctctcctctctgagcctcccagcatccaatggcctcctgccaccgctgtggttctgcctggtctcctggggctgggattcaaggtctagaactctcctttcctcccagcagctatagccttttctcatggccttccagttctctctgcaactaactttcaggctgacaaacaaataagccctttcatacctttgtgggattgataatatctgaaaacatgtggcctttaagatcaatttttgaatctggagataacatcattgggccagtgtaaaattcttatcccaagaccttaatttccgatggtgaaatttaggcattgtggttatagacatgaagctgtgtcattgtgtgcataccaaaccttttccctacccaacaaaccttttcttcagatctgctttgcatttaagaacacttcatagcacaattcgtttcctgcactttggggcaggaaacaaattgtgctatgtagttcattgggaagtagaggagggaggggcaaagagagaaagagaaagaaagaaagagagatttagaaaggcaactttccccccaaagtttctcttcattgcctgtgatagtgcaattataaatgctatccttatttaattaactcgcaaatgggaaccaaatgtagcatcagcatatcggccagtgagaaggtagagatatttttgtgacttctctccatcaaactgtgtgatagggacaagccattgaacttctctgagcctgtttcctcatttgaaaaatcacagtaatgattccaacttcactagtgtttgtgaagatgaagcgatatatgaaatggtatgctttacaacctataaattactttggtaatatagggcttacatcatatacatcaataaactaatgtgccttctgtgggcccagctggggtatacccaaatgcaccatgaagccagctgccctggccaatctcctcaccagtgggctgagaggcctccctctgttcttccctcccttcagggattagcctaacactcacagagctcctggaagccccaaggctgtgcttgcaggactgcaggctgcggtagactctgttctgggccactgccctgcggaggccaggctccttgttggtaaggccaggagcgccctagctcttgggaaaaaaaaatgttagaaatgtctctaggagcctgtgtgatgaaatggtacagccctgctggtgctttgcagacattgaaggtcctgtttcacttgatgaaaagtttgtgtgtggagaattctgtccccagactgagggaccccacaccaacatgcgatttacaggggtacatgtccagatgccaagggaaagcagtcgtcccttctgatcccgtgttagtggggtgcctgacagaccctgtgacttaggccccagtactcccaccctgagccctgggtaagcaccacacaaatatacagatcacaaatgagaataggcccccaaactccctactttcatttgaaactgtttgtagcagggctgagaactgtatattgaccagaacatcagtggcctcaagactgtcaccatctgaatccagtgttctcttcctgctgtttcccaccctcctgaatgaaatctataggataatcatgaaggtagattttaagacaccagggctgtcatctaggtggcataagtgacagatggccttccaagtgtgctgtggacactgtagttgctcaatgataggcattgtcctgtacagctccccatcttcatccagttcatcatgacccccctgggaacaggggacagagtagactggagtgtgcagaacttgggaactggagaattttgtagaagaaactgatttggggacacattgcatttaatgtcatttcaggacatctgaatgggaacatccaggtagtgatatagggtgggagcttgggagagaaacgtagtcctgtccttgggctaatcacagcctgagcataaagaatcttggagagagcagagaatcaatgaagagacttaaggaaagcactgatttcgggttcagaagagaccaatgttagcccagtgaaccaacaaaggaaggaacaggcccaagcctccaccagaagtttacttcagttttattgaaccaatgcctactagatgcggaactacatttcactcttgctgtgtaaatactgattacatttttttccagttatgatgaagtttagaacagtgtatttttagaatgtaattttgctttgacatccctattttttatttttatttttatttatttattttgagatggagtctcgctctgttgcccatgctggagtgcagtggtgaaatctcagctcactgcaacctccgcctcccgggttgaagtgattctcctgcctcagcctcccgagtagctgggattacaggctcgcaccaccatgctcagctaatttttgtatttttaatagagatggggtttcaccatattggccaggctggtctcgaactcctgaccttaggtgatccacctgcctcagcctcccaaagtgctgggattacaggcatgagccacagtgcccggcctatttttattttattttattatttttgtggtttgctttgacatctctataacctgcaagtttaacttccctttggaaactgcacagggctttttttttctgttgcaaaaaaatgtattttattacttgagtaaaattacagtatctctgttgttaataagtattaaatgaaattgagcccctcccctttcctttcaaatttccgtgaaagtgcatgtaacagtccatttttttcttccatatctaatacaaaataaacactattcctgctctcttgatcaagaagaagcatttgctcttgcaaggaacatatggacatttgaatgaaagtgatatttcttatttatatacaagagcatttacattttctctactgaatattgttcaagatgctatacttagcagccttgtgaaattccagcacacattttctatcatgtatatacctacacagcaaaatgttacgtcttagttcaactaccaaaacaacacttgtttgttttctctaaagaattctgcatgcttattactgcacagaaatgcattaatattgaagatgactcatgtaaaaagcacaatacaaatagcaattcaaaaaggaaatggttaaatctacaaaacaaaaaaagtttgactttttgaataaaaataaaaaaacaaacctgtcaaacaaccacactgttcagtctgtactttcagtcctttccttaaatctgttttgaaagattagacaatgtgtttgatgataaaaatttccagcagaatcaaagtgtacatttatgtacagactttattagagatctaatgcatcactgaggcattgcatcaacaccagattcatattaaactggatataaaaaataagttaatgccagattacaactgcctagcagggcaacttgcaattgccatacatatcacagcaagtttacagcactctagctaattagtatttagtccaaaatacataagaccaaagttaatactttcattccgtttgcaaagcgaggttatatcgctaataaataagcttccttagaactccaaagttgaacagggtacaaaagaatatcttcatgatgttgtaattcatagatctgggaaaccagaaggaaggggtatgggggcaaggggtaggaggccaccacaggtcgtattctgaacaggaatgaatgctatgtttccagcccaagctgctttaacttgtgacgatctctttgctgtcctccatgaagcgggtgaagcggaattggttctcttctaattgcttgccattttccccaggccggccagagaagcagtgggctctgatttctggagcttctccagatttcctgtcagcccactaacaggtgagctgttcccagtgtcgaggcttccaggaattggatggatgccaccattctgaatgacggaggtcccgttgcccttcatcgccaacccgttggaatgccgtgctgcattctgattccagaagctggaaggatccccacttcctgatcttgccaccaaatccttatggaacatttctgggaacttgatgggattgcctcctagaaatgtcatgggcccatccccagagagctgcctaccctgtcacacaggggtgctattccacatgtgagtgcccgtgtgtaccttttgtcgtgaaagctcttccacaaatagtacaagcaaacagtttctctccaatgtgagttctgccaggcactcaacgagggggaggttttgccacatgtgttgcagtagtgctgcttgggagttctgggcagagccaagagcagaactggagatgtggcagagaaagacagaggcccagaagggatgtgactggtggggtgtccttactgtcctgaggagaaatatgcacaaagccgttgatctccgttttgctgagagatgacaacgagttggcgggaatcaccacagagttctgattggggccaagattggaactgggctgaaagagctgtgatggtagatcttgcatctgatgtatcaacatgtgctgcttcaaattaccctttgtggaaaagtcacaattgcaaactgcaaataaatggtctctctttggtatggtttctatagtgaatgtccaaggcactctgacaagcaaatgttttgccacaaatgttgcaagcggtgtttttaaatttacgctggactctgaaagggaagagggtccccagagaatcttctctgatgattttctgtatgtgactggatgtcagatccaaagccccgccattcactggaatgaaagacaaaccgttggcaaactcgcttgggaccactctctgtggtttctcctattctctgggtgacttatggaactcctgggtgctgttggatggggacagagcctgcatggaagacgtagactctgagatggctgggctgccagcactttagctctccatgtcatcacccactgaggatgaatcattgatcaggacatcatcctcgaaggacccattctccactgacttcaggctggcccgcagctgctccactaggccaacattcatcatcttcatctgattttccaaagcagtgatgctcgacatctctaggggcaaaggcgaagaagataaactgtcttgggagtcgtctgcagacttgggcatatcagggaatctgccctcaggacagtcttccattttttcactggagaagttgtctaggtcatcaaaatttttcccatagaaggagcctatgtcagactccatggactcagagtaactgctggggactggagtgttggagacctggcctcccatatgcattcgagtgtgctgctgcgggatgacagcatcgtctgtcaacttccagcagatggggcaggaatgctgggctctgagcaggggcacagcatgatggacactgtagtgggttttaagattcctttctgtgatgaaaacctggccacagatcttacacttaaaaggcctctccctaatgtgtgtccaatagtgcatttacaaggcactctgacagctgagaactgggtagcagatgatgcactcactggggccagtggccttttgtcaatgttttctaccagttgctgaagcttggatgtctctgatgcctgggctgagtccaagagccccccagaaggaaacttggccttgaactgcttggacatgagaggcaacaaagggttggtgaaggtggtagtgcttccccagggggccccagtctgctgctggggagctcagggcactactgttcgctgtcaggaccgagttggtgaccacaccactctctttgcttttgccactggagggtggcagagtggacccttcagcttcctctgggagcccacctaggtttcttgtggccagctcggcggccctggagtcacttttgactaaacctgtgggactggtggcagaatggctaatggggaagggggctggctcttccgtcttgatgaagagtatgaggcttgggagggttgggagcaatggcaggcagactgaagtggtcagagtagccaggactggtttggtgtctaaccagctggtgaccggcttctctggagtgatggacatgccatatgggatgccagtactcatggggatattgtccaaatgctcaggcacaggataagggttcatctgggtatgggtgtatttctctttgtggcactgaaagtggactttcagattcttcttggtggagaacccgttcccacagatgttgtacttgaacgccctctttccagtatgggaatgcaagtggatctgcaaggcactgtcgctctcaaagacctttgtgcagaacctgcacttgcgtttgaagaatgcctcattggaagtatttttcacttcaaaggcagtgacatttggtggcttgctttttctttgctgggccaaggcagacaaggagtctaaatcccctgcagttgttccaatgttgggcaaagggctggggaaaactgagttagcgggggccaactgatgtagaagtggatcagatgcaggacttaataaactgcttattgcaaaagctggtgaggatgatgatgagacagctgggttgctgacatgggaggccgcagctcttgaagccaccttttctgaggacggggtggtaactgacaccaccaatatgttcatattgggagaaaagccactgttggatggaatgatggtgttgccagaactactctgaagtagctggattggggtagctgtttcacaccactaatgctagcagattggctggcgaggctctgtgacaatcaagctgctgctgccagctgctgagataaatgggaatttagcatggacaaggggttggcagatgtttgtaaagtaccttgagaaggatgagaagatgttggcaagtctgcattctgagaagccaacagcaatatttggtgacaaatctattcgatcagttgcagctagtggacctgctgctgctgcatacctaggagctgttccatgagggctgggatggccaacttgccccaggaagccccacggcacctcacttcctgggagaactgggacaccaccaccttggtgctctggaggttctcgatgatgacgttgctgttgatcacggagaagttgcccagtgttgtcaggtccccgagttgaggtagagaggttgtgatcactgaggtatctgtgggggagctgctgctgctgctgccacttggggcaatactgctgtggctgtggctggaagtgctgctgccacttttgttagctactggggcctccacctccatggactcttccctgtcaagtctgttgtgttctgaaaggtcgctgcagtccacttgatctgttttgttaactgtttcattcatttgttcatcaggattattgggagggagcctgggggagaaggttttggatggggaggctggattttcatttacaaataaaactaattgatttttagtacagttcttcttgtggagcagaagatgtgataattcaaagaacttggcacagcactggccacagatgtgggtgtccttgctcttagtgggaagacttgattgacccttttccctgtctccacaggttcaagcgaatctcatgccttggcctccccagtagttgggactacaggcgcctaccaccatgccctgctaatttttgcatttttagtagagaggaggcttcaccatgctggccaggctggtcttgaactcctgacctcaagtgatccacccaccttggccttccaaagtgctgggattataggcgtgagccactgtgcctggcctgcatagtacttttaatttaatcttgtcagcttaatttttttctatgactttattaagttataattgttattcagtagactacacatatttaaagtgtagacaatatgatgagttttggcatatgcatgcacccacgaaaccatcacaagaatcaagatagtgaacatatgcatcacctccaaaagtctcctcgtgtccctttgtcatccctccatcccatcccttcctcctaccttcccatccccgtgaaaccactgactgctttctgtttgtatggcctagaattttataaaaatggaaccatatagtatatactctttcatctggcttcattcatgcagtgtaattattttgagattcattcatgatgttgttgccaaacaccagaggtttggcctaggtccagttgctcatcacacagaaagccaattactgagacaagtgttgtccaggaaaaaaggctttattgcaggtgatgtcaaccaagagatgggagacaagtctgaaatctgtcccttcaactgattaaagttaggggtttatatagcaggaaaggaaaacaggaattagagagggttagggaagaggagttggtcaataggcagcaggtgtatcatactgtctggatgtgttgatctctaaagccccagccccactgacaccatctaggggcctattggccagtctcctaagaaaggaactcagacaagacaaatgtaagtttctaaagcttcagttttatgggaaacttgggctagtttcaaggtttctttaatgtgctaactttatagccccatctagtaagtctgaagtttccaattttatactctcattcttttggctaaagtctctgatagcttttataatacatgccctcttgagaaaggtaaaatgtagacatgatcagacatgtacactttcaggtgaagatcttgtcagaattgtttttctgagaataggttttgttagaagtctggtagggctaagttggaaagaataatgcttttagcatctgacaggtgtccttgagagaaaccaataaagcagccaagggaggttctaactcctgaaaacaaatgtttcagaacttccaatgctgtagagagctggccctctacagggcttttctccgtgaacttcaacttgcctgtcgcgaaaatctcttcataaacattcagcttcctttggatctgggctgtaaatacttgcctggactcaaggatcccctaactttatgatgtaccttttatgtaaatatatgttgacttgctggtttgtgtatgcattgcatgtaaggtctctttttaaagcatagatttaaatattatagaatataaaagataaatgtttctctactttctaaaataagacactttatttagaatgttaagatagcccctgcctgttatgtagaaccattaagtatcttgaaaaattaattgtttgttgcatatttttaagagctctgactgtaatcctgaaatgatttctaatgactgcgggagaggaggagctgactgctgctacaaacacatggacacctgaattcacacgtcttagtggccactttagccttgagaagctgattatgaaagatgtgaaacaactccagagttctgcaggtgtataggggatgagggtgggtagcaaatgccataaaagagcaacaacaaccaccctgataaaaatattaggaacaggctgggtgcagtggctcaagcctgttatcccagcactttgggaggccaaggcagaaggatcgcttgagcccaggagtttgagaccagcctgggtaaagcgagactctttctctacaaaaaatagaacaaatgtgtaaggtatggtggtgtgtgcctgtggtcccagctacttgggaggttaacgtggaaggattgattgagcctgggtggttgaatatgcagcaaactgtgatcatgccactgaactgcagcctggatgacagaaagaccctgtcttaaaaatgaataaataaagtaaaaagaaaaaattgggaacaatcatcattattttaaagcgttataccctggaacagggtttctcaacctcagctctattgacatttgggccagatgatcctttgttgtggggcctgcctgtgtattgtaggatgttttagcagcatccctgacctttgcctaccacaggccagtaatcctttccccagttgtaacaaccaaaaatgtctctacgctgggcgtggtggctcacacctgcaatcccggcactttgggaggctgaggtgggcggatcccttgaggtcaaggggttcgagaccagcctgaccaacatggagaaaccccgactctagtaaaaatacaaaaattagccaggcgtggtggcatacccctgtaatcccagctacttgggaggctgaggcaggagaatcgcttgaatccaggaggtggaggttgcaatgagctgagatcgtgccattgcactttagcctgagcaacaagagcaaaactttgcctcaaaaaaaaaaaaaaaaaaaaaaagtccctagatggctgggtgcagtggctcacagctgtaaacctagcactttggattgctagagcccagggaggattgcctgagcccaggagttggaggccaccctgggcaacatagtgagacttcgtctctataaaaaaaaaaaaaaatgtctctagacattgctgaattcccctgggggacaaaatttcttccctgctcccctttgagaaccattgccttagagtaaaatattctaatatacatttattacaaaaaaaaccccagctttcttgagatataatttacatgccatacaattcacccttttaaagtgtgcaattcagtggtttataatgtatttacatggttgagcaaccactgccacagtctaattttaggacatttttgccctccctaaaacaaaccctgtgcccgttaacagtccctccccatccccccaacccctgcaaccactaatttatcttctatctctatggatttgtctattctggatatttcatataaatgaaataatacaatatgctgtcttttgtgactggcttctctcacatagcataatgctttcaaggttcactcacttttagcacgtatgagtactttattcctttttatgactgaataatattccactgcatggaaaaaccacattttgtctatccattcatcagttggtgaacacgtgggttgtatccatcttttggctattacgagtaacactgctatgaatattcaaatacaagtttttgtgcagacatattttcatttctcttgaatgaaaggaatggtgtttctggggcatataaaacactttttaaacaggaagttcttcttttcaagatacgtcttatggcaaacctccaaatacaagatatatcacagtggagtgtttgaagtgaggttagctggagctccagagccctgcctgggctgccatttgacagccctggtggccttgagatgtctccacagaacaccttccaacaaaaaaaatttttttgagacaggatctggctctgtcacccaggctggagtgcagaggcatgatcttggatcactgcaacctccgcctcccaggctcaagtgatcctcccacctcagcctcccaagtagcagggactacaggtgcatgccaccattcccggctaatttttgtacttttttgtagagatggttttgccatgttgcccaggctggtctcaaactcctgggctcaagcactcagtctgcctcagcctcccaaagtgctggtattacaggtgtgagccaccttgtcctgcccaaacaatattttttctttttaatgaacgattatcaaccaagctcagaactttaatcaaaaaggatacaaacacaaaacagtttggcaattgctgtctgcttctttgtgtctaggacacctccgtattaaatctcgaacattgaaatctcatccttcatttccttcaggtctcacatcttggcttgacatgccttttcagttttctctttcccttcctggacagtagtgtctggatcttacttttttttttttttttttcccaagtctcactctgttgcacaggctggagtgcagtggtgctatctcggctcactgcaacctccacctcccgggttcaagcgattctcctgcctcagcctcccaagtagctgggactacaggcgtgtgccatcatgtccagctaatttttgtatttttagtagagacagggtttcaccatgttagccaggatggtctcaatctcctgacctcgtgatccacccacctcagcctcccaaagttctgggactacaggcgtgagccaccgcgcctggccagatcttcttcttctttttttttttttttttttttttttttttgagaccgagtttcacttttgttgcccaggctggaatgcaatggtgcgatctcagctcactacaacctccgcctcccgggttcaagtgattctcctgcctcagcctcccgagtagctgggattacaggcatgcgccaccacgacgggctaattttgtatttttagtagagacggggtttctccatgttggtcaggctggtcttgaactcccgacctcaggtggtccgcccgcctcagcctcccgaagtgctgggatcataggcgtgagccaccatgcccagcacggatcttacttttatctcctcactccatgataactgtgcagtttatcttgggttccccagcagtctccttcttatctctttttctctggcctatgcagcctgccccagccatgctaaacttcagaactgcattgctatgatttgttctcttcctttctgtcaacataaattcagattcacttagtttcttcattcattcatcagatatttacgataaccaagatttactatgctcggaactgcaggagttccagatatacagggaggagttcctgtctttcattcagacagataagacagttacagaatgcccaccttagaagatggtatatgctaacagccgtttgaacggtacaagcacaaaaatagctagagacgtcttcatgtgagattggggatgacttcgtaaatgggacagcactgaagaactggcaggaattctttacatagaggtggtattagggcatctggtggagagggtggcataagcaaggtcacggaaataggaaaacacagatgatattctggcaattatgagtcaaataattaaagcaggtgagtaatgagacaaagtagtatggttacatagaccaatgagaatggaaggctttgaaagcctgcccaaggggttgaagtttatgtagtggacaatggaaaacaagtgaagtgtttgaaggaatgactgatgcaatccaacctggagtttctctgatattgtagttccgcaccctggcccactgttaggagatgattcggtaaaaaggttttaaccagagggaactcccttcattatttcttctggttactttacctctcagggcctgattttccatgacaataaatcaaaggagactggacaaaatgatctttccagcatctctattcctgaatcaagcatggaccaggaagccctgctgctttttgaagagttagggacgagttgggctaagggctgtgggaagatgacaaggaacatttgtgagatttccatggggaaatgagtcatatttggaaacatcagaaagtaagaaaatctttgtctataatctatccagcttccctcttgcatatctttttccttttagtggcttcctctccacctttaatctagaagtttataaaacggcttgggggatgaagcacacatgctttgtcttatttttctatccctagtacataacacagtgcctgattcatggcctgtcagtaagactctgataataaataatttcttccaacccctgtcaaaacctactctcagagagaaaatatgtaagcaaattcatactaaggtataaatggctgataaccatttaaattgtgatccatatactaagaggaatttttcttataagtaatggaatagccctttgctaaaatcaaaacccatttctaatagtggcatacatagaactaggggaggcttcaggatggcagcagtgatatttccagttgggatctcagccactattagtccctcttatcctaaaggggcttctcaattcccacctagaggctaagccttgcctcattctctgcaatagatgctgtctgttctcagcagaaatttctggagccctgttttaacattctggagctcaatgttgggctctgcttgcttcaaaactggttctgggtatttatagctcatttcatagaactaggcttctgtttggtttctccagcctgggtatatgccgcgacaacatgtccactcccctggacactctcagataacagttctgtgcttatctctttctagtatatcttaacacctttctcccatctgactctgcatggagtcaacttttacctttgatatctagcccagtacccatcacctttctccctgttgtaagatgaccctgctgctgactcccaacttgcttagacttccaagaatcagcagccaatgtgtagcctgccactgataccctgtcttcctaccctgagaaccagccagaattcctggcacttcaaattggaacttcccctgtcccctcagccaaacctaactactgacctagactgccctctgccatttgttcccagagcccctgggcattacatttgtcctcttgaaagggaatgtctctgcatctgaagttgagtcagctctcctgtgataagggcttagtgggtctacttctaagccctggctttatcttaattgaactgaccttgccatggcctggaagatggcaagcaagcatttatctggagcacctgatatcagactctggagctaatgatctaccctgctaggttataaggaaagcttcacggctaacattttcttgtgggagtcacccaggcaactgaggctgccttgttgccacaagataaccttccatatagatatttttctccagttagacatcctttattcaacttgggggttgcatttgtccaaaattttcttccttggcatgtaggatagttgacctaactacctactatggtcttccacctgccttcttgtattaaatgcctgttgcatttgtcctaggcagaaatgaatttcattgatagagggaccatatatctgcactgggtggatagattcctttatggtgtaattccagggattcacagaaagtatctgctcccaaatatgtctcccacatgatgatgtgtgtcatcattatttccatccaatctctccaatgggtgggcctcaatttctacttgttttcaaagactcagagtaacttggagagaaggacacagcaacgaggaagaaaatatagttagtaattatgattacttcttttggatcctccctattatacaccaaggtgtataatatgaatttaaaagaatttattggcttacacaaatgggaactgcagggatccatgctttgggggtacagctggatccaggggctcaaatagcttcatcagtgctccctcatggtgccttctctggtatgcaaaaaaggtcccagggaggactctgattggttgatttgtgtaatgtgccctcctttcatccaaacactctgcttaagaggatggtcgatgctgcttggctagcctaaatcacaggaggcccagcccaatggtcaggaggggaaaatagtttcactctaaagaaactacgagaatattgggttatctgcagggtaaaggggttcccttaccagagaagggcaaatagatgctgagatggaaacagtcagatgtctattttaagggtcagggggataaaggggctgtactgcatatttgcctagacctcactttgggttatccattgctcacttcattatcccttgttaaaatataaaggtgggagtggggctaaggaatcatgctgagtcttaactcagtgtgaaagggtttgttcaaaatgttctattcccactgacccaggccatagaacactttggagaacaagtctggaagcctaaaatgggagggtcctaaaaaaaagcacaaaggagggcacaaagcggggtaccaagaaccagtggatatccctggcctatcctatagcatggtcctgggccaagagccagcctgaggatttgcatatctgcatgtaaatggatcttaagttctggcattcatcttgagcagcttggagctcaagatgaggttcctttcccatctctcccctcccctcctctcccctcctctcccttcgcctccccttcccttcctttcccctgagcaccttttcaccccaggagctgttcacagctccttcttcagaagtcttctctctcttcagataagatggctttctctccttcgccctacagacacactccaaggacagtgacacatacacattcagacagaattcacgattacattttgacgagagatgccattttatctaaaagcaccgtccatgtgccaatctaagggcagaaattaaaccctaaaccaacacaattacaagtcaatagtatcattagaaaagactatcactaaaacgtttgtgtattgtggcttaaattcaatcatggtaggaaatttgagctgtttctgggagataagtcttgcataaccagaaactgaatgctctcttcttttcccaccagcagcctcatctccactagtttctaagagccaacctgtccttagctccattgaactatggctatggttacttcagggtcttacaatgatggtatcctttctactccttgaaaattatgtttgccataattacctctcttgtgtccttttcttaagaccaacgactttgctattagtgttgaaggaaggggccagcactcctaagcatccatccacttgtaagcaagtacgtccgtccaggctaccattaatatcttttgtttcagagctttttgctttatttcacaagcactcttgtcttgtttcttgcataggatctcctcatgaccaggttctataaaactcaagagcaatttgagtgtaagaaacattgctcaccagaacgtccttcctactcatgatgatactcctgtttccctttcatcagcccctcatcgttgatcttcatagacaaactcttgtcccctccccaaattctgtgtggcttggtttttgaccccagtagatgaggtaactgggtgtgtcagcaattagactgacatccctgacccctggcattcagttgtaacagtagtctctgtctccaaatggggtttctcctgccttgatgttgggcatttcagatgtaccccccaagaaaaatggagtgatgtttgctgtgtgcttctgtctgtttggcacaggacctgtttctcggtgactcctaaagctatgtgcctttggagcaaaagtccagactggcagaaggagcctgttgagtgctgaagaatttagagacatccatctccagttcagttgcttttctgtcaaaatctcagtccctacatctctcagaaatcccaaactgctccaatcatcccagcttgcaatttggataccttttaatgctatgctttttaacgttatgaaaaccaaatgtgtcagaatgtgtctttttttttttgtgggctcgctgagtgcttttgcactacatcatttattgtcatgcatctgtaggcttatagtctacttaaaatttttttattttacaataatttgaattcattcgctttccaacctgcttattgcagttcagggtggcaggtggccagagcctatcctggcagctcaaagggcaaggtaggaacccaccctggccaagatgccatcccatcgcagggcacacttacacagacactcacactcacttagaccggtaccatgtagacacacccgttcacctaatgtgcacagctttgggatatgggagaaaactggagtaactggagaaaacccatacagacatgggtagaacctgcaaactccacacagacaatagacctgctgggaatggattttttccctgatcaaggtaataataaaataatgttgaaacaaatgacatttttcgaggacttctgtaatgctaactgaaaaatagttgaactcaactttataaatattgactataggtttgttattgttgtttttaaaagaagcccaagcaacagtaaagctaaggagagattattcagttttgttacacgggagggagagaagttaatttctgttgctttggtgttttgtatttatctctcattacaaaattggataaaaacacaattttaaaggctgcactatatattgtcatttatcaaggacaggaaaaagtgaaacccatacatctccattatgtggtttctgaaagctgtgcaaatcttgaacacaagctgaaacatcatagaaaccatatctcagagctgtacaaatttcctgctgattatacagagaaagaacatgtgattaccaagagccttgagtagatgtaggagaaaataatgttgggttaggtatctggttggtttatctgatgccagagttttatctatttgggtctgatgctttgattgtttgggcttcgttgtttttttttttttttttttttttttgtaagtgagagaggccagtatgggatagaggaaggaggcaaagtgttggtggatttcccacattaatctagccaataccacatttcaatgttgtaagcttcctttttcttatggtcttatccttcttgccccataagcttggcatcctctaatggttatttttactctgttatccatctctaatagcaaaaataatctaaataaaatatagcctcaactgtgaggctattttcctctaaggagctagatgctgttaagggttgtagacacagactttatttcatttaatagtgatgatttttcttttcatccttgtgcctgtattaagtgtagcaggacagggaagccccctgccaaaattggggcttagcccctgagggctcttggctttgcccaggaaggaattcaagggccaagtggtggtgttatatggcaatcttctattgaatggtactgctccttgcctagcagggctaactcacaggcagtgtggtccagagtcagcaacttaggggttcttggcaactgcattaatactcacgtaaatccactttcaatcacatgcaaattaaggggtcagtcaatgcaaattgaggggcaggttatttagacctttctaagaaaagggtggtaacttccaagccattgttacggaaagaggtggtgacttctgggtcattgctgtggcatttgtaaactgccatggtgctagttggagtgtcttatgccaatgagcaatgagagcaactaaagatcacttttgccttctgctggttcctgctcgtttcttcactttatcccatctggaccagatactgttttggtcagcagggttttgaccagagaacaactcctgctggtctgctacctcataagcagggcacaaaatctagtgggtcccaccatgatttgcctctttggagcagccaagatacctgagtctctgtactttgacatcaaattccacttacataaggcagctctgaaaagtcagagggtagtgggcctgggtcaacactgtctgctttcatcagtcatatgcctgagacccagggtggggagattcacattgccaccattcaggcatgtacagaagccttcattaacatgtgcttcttgagtacaggaaagaatggggcagggacccttatgagtctttaaaacattttttttctaatttttaatttttatgcacacacaataggtgtatatacttatggggtacatgtgatgttttgataaaggcatactatgtataataatcacatcaaggtaattggggtatccatcacttcaagcatttatcatctctttgtgttaggaacattctaatccaactcttttagcgattttaaaatataaaataaattattgttgactatagtcaccctgttgtgctattaaatgctagatcttattcattctaactatattcttttaccctcatccccacattatcctccctccacttgctcccctatccctgctacccttcccagcctctggcaacaatcattctactatctccttgagttcaattgttttagcttttagctcccacatatgagtgagaacatgtgacatttgtctttcagtgcctggcttatggtgcttaacataatgacctctagttctatccatgttattgcaaatgacaagatttcattcttttttttatgattgaataatattccattatgtatatttaccacattttctttatccattcatctgttgatggacacttaggttgatttcaaatcctggctattgtgaatagtgctgcaataaacataagaatgcagatatctctttgatatactgatttcctttcttttgggtatatatctagcagtgggattgctggatcatatggtagctctattgttaattttttgaggaactcccaaacctttctccatagtggttgtacttattcacattgccatcaacagtgtacgagggttgccttttgtgtacatccccgccagcattcattattgcctgtcttttggataaaagccattttaactggggagagatgatatctcattttagttttgatttgcatttctctgatgatcaatgatgttgagcaccttttcatatacctgtgtgtcatttgtaggtcttcttttcagaaatgtctattgagatcttttgcccattttaaggtcagattattagactttttcctgttgagttgtttgagctacttatatattctggttattaacaacttgtcggatgggtagtttgcaaatgttttctcccattctgtgggttgtctcttcactttgttgattgtttcctttgctgtgcagaagattttgaacttgatgtgatcctacttatccattttttgatttggatgcttgtgcgtttgaagtattactgaagcaatctttgtccacaccaatgctctggagagttttcccaatgttttctagtagtagtttcatagtttgaggtcttagatttaagtctttaatccatcttgagttgatttttgtaatggcaagaggtaggggcctagtttcattctttgcatatggatatccagttttcccagcaccatttattgaagagactgtctattccccaatgtatattcttgctacctttgttgaaaatgagttcaccaaagatgtgtggatttatttctgggttctctattctgttctatttctaccattttaagaaaactacatttgtgtgtgggtgtgtgtgtgtgtgtagttctgtgccactatcacaatcaagatatagagctggctcatcaccacacaaggaatcccttcatgttatctctttttattcattcccccactcttttctagagtcgccacaccatttttcattcctatcagcaatgcatccttctgtgcatcctcaccaacatttggtattaccactttttaactgttctaataggtgcataatgatatctcctcgtactcttattttacatttatctaatggctactgatgttgaacatcctttcatgtgctcatttgccattcacatcttctctttggtgaaatatatgttcatgtcttttgcccagtttctaattggattgtttgcttttttattgttgagttctgagagttctttatatattctagctatagggcccttgtcagatatgtggttggcaattattttattccagtctgtgatatggcttgccttttcatcttcttaacaggggtctttcacagaacaaatgtctttgattttgataaagtccaattcatcaatttttccttttaaggattgggcttttggtgtcaaatctaagaactcttcatctagtcctaggacccaaagatttttctcttatgatttgtttctaaaggtcttagagttttacattttgcattaagtccatgattcattttgcactaatttttgtataaggtatgaggtttaggtcaaggtttaattttttttgcttatggatgtccaattgttccagcacaatttgttgaaaaggctctcctttttaaattggattgcatttccatctttgtcaagaatcagttgaaaagctagatgtggtggtgcatgcctgtaatcctagttacatggaaggctaaggtgggaggatcacttgagccaaggagttcaagtccagtgtgggtaacatagcaagaccccatcaaaaaaagaatcagttgtgtgggtctatttatgggttttcaattctgttccattgatgtatgtctatctcttggacaatgtgataatttctttggttactatagctagatggcaagtcatcaggtagagcaattcctcccaatatattcttcttttcaaaattgttttagctattctagggtttgtgcctttccatatgaattttagaataagcttgtctatgtctacaaaaaacttgatgggaattgcattaaacttaaagatctatttggggagatttgacaactccactattttgagtcttccaatccacagacacagtatgtcactccatttacttaggtctttaatttcttttatcagtctcttgcaaatttcagcacacagatcttgtacatgcttttagatttatacctaagtatttcattttctttaatgcaattgtaaacggtattatgtttttaatttccagcttccacaagtttgttgttaatatatagaagtgcaattgatttttgtgtatttatcatcttgtatcctgcatccttgctgaactcacatgttagttatagaggggatttttttggtatattcttcgggattttctatatagccatctgcaaacagggatagtttaatttcttccatttccatctgtatcccttattttctttctcttcttttttcttttttttgtcttattcctccgctagaacttccagtagtatgttgaataacagtggtgagatacatacatctttgcctttttcctgcgttgggggaaaacattcagtctttctcaattaaatatgatttttagttttttgtagatgaactgtatcaaattgaagaaattccactctattcatggtttgctgagagtgtttttttttaaatcatgagtgggtgtgggattttgcagatgctttttctgcctcaattgatatcattatttcttcttggtggattgatctttttattatgtgatgtccctcttcatttctagtaattcgctttgctctgaagtctactttacctaatattaatgcagtcactcccagttggtttttttttttttttgagatggagtctcgctctgtcacccaggctggagtgcagtggcatgatcttggctcactgcaacctctgcctcccgggttcaagcaattcttctgcctcagcctcctgagtagctgggagtacaggtgcatgccaccatggctggctaatttttgtatttttagtagagacagggtttcaccatattggccaggctggtctcaaactcctgacctcgtgatccgcccactttggcctccaaaagtgctgggattacaggcgtgagccaccacgcctggcccactcctagttttttaaaaattaatgtttgcattgaacatgtttttccattcttttagtttctatctacctatgtggtcatatgtgaaatgagtttcttgtatatggcatatggtttgattattttttatccactctgttaatctctcttttaattggcccaggaatgaatatttaaattttttcagtacttattaattttttttaaaaattaacagactttttttaaagagaagttttaggaccacatcaaaattgagaggaaggtatagagatatcctatatactcctgggcccaacacatgcacaattctccccattatcaacatcccccaaaggagtggtacatttgttacaattgagcctgcaatgacacatcattatcacccacagtccatagtttacattaggattcactcttggtgttgtacatttaataagtttggacaaaggtataatgacatgtacccaccattatagtatcatacagagtagattcactgctctaaaaatcctccatgctccacctattcatcccttcctgctctataaccctggcaaccactgatctttttattttctccatagttttgccctacccataatatcatatagttggaatcatacagcatgtaatcatagccaagtaagcctttttagactggctaccttcacttagtaatagaaattaaagtttcttccatgtcttttcatggcttgatagtccatttcactttacggctgaataatattccactggctatctgtagacagtttattagtccattcacttactgaaggacactttgcttgctgccaagttttggcaattatgaataaaggtgcttaaacaagcaatcatgcacacttctgcaacaagaaaaaacagaaagtcccgccacaaaaaaagaatatttaaagaagaaacaaatggaaattttagaagtggaagatatgataaccaaggaaaaaattcccactgaatgggttcaatagcagaatggagacaagcaaagagttagtgaacacaaagatagataaaaagaaattgttctatctggccaagagctgtgacttacaccagtagtcctagcgcttttgcaggctgaagtaagacaacagatggctggatgctagcagtttgagaccagcctgggcaacatagtgagacctcatctttataaaaaacaattaaaaatagcttgagtgtgatggcatgtgcctgtagtcagctactgtgaaggctgagggaggaggatcccttgagcccaggagttcaaggctgcagtgagctatgatctcaccactgctctccagcttgggcaatagagtgagaccctgtgtctaaaacaaaacaaaaagaaattgttcagtatgaacaagtcagagaaagaaactgaaagaaaaaggaatacaacctcgtggacctgtaagaaaatactaaaacatctatcatttgtagcatcagaatcacagaagaagtgaaaatattagggaaacaggagtctaggacagccagagtgaaaccacttgaaaatcaactccatcttgaaattaacaaggcacattccttgccagtcacaacccatggtcctaggatgtttgcagttgagaaaacagaataaagatacctacaaggacatactcccacagcagcggaaagtgcagggatcccaacacccataacaatatatgcgttcaaaataattatagttatgctttgatgtacttacacattagaaagtcaaggatagttttctttaaatcaatagaacgataaatttcatcatgctgttagcccacccacacaaacgtacaggtaagttgagtctttacacagacaagacccctatgtaagaaaaatgtggccaggccaaggctcacacctgtaatcctagcactttgggaggctgaggtgagcagatcacctgagctcagaagttccagagcagcctgggcaacatgacaaaatcttatctgtacgaaacaatagaaaaactagctggacatggtggcatgtgcctatagtcctattcaggaggctgaggtgggaggatcccttgtgcccaggaggtcaaggctgaagtgagctgtgataacaccacagcactccagcctgggtgacagagtgacactctgtctcaatttttaaaaatataaaacaaaaaagtacaaatttatcaatctaattcactactttaacagattaatgaaaaaatgcggtgataatcacaatagatgcagtgtttgatgaaactcaacatatatccaaaatgaatactctcagcaaactggagcagagtggaatgactgactgttgaagtcaatctacaaaaaaagtacggtaaatattatgttgaaatgttgaaatttttccatttctgatcagggataagacagggatgtccactatcgccattataccagtgggtctgcccaatgcccctaaaatcagaaaaggaaataaaagtgtttaaaatggcagcaacaggccgggcgcagtggctcatgcctgcaatcccagcactttgggaggccgaggtgggtggatcacttgagctcaggagttcaagaacaaactgggcaacatggcaaaaccacgtgtctacaaaaaatacaaaagaaaacagaaaaaaaagtggcagaaacaaaattgttcttattcaaagacgatatgattctgtatgttgaaaactgaaaaggatctagaagtaaacttttagaattaataagcatatttaacaaggttgctggatagaaactcaatatgtaggaattatgcctctacataccagctcaaacagctagcatataaaatgtcaaagaatgatacacatttcagagcatcaaacacctggaagtaaaattaacaaaagatgcacaagacttctttgcagaaggctgtaaagctttattgggagaattttaatggtcaaatttccaacacaggagcagcctgaaccatttcagcgtgtcttcttttaaggctgtgattgcccttcatctgtaacagaaacataactgttaggaagatgatttagcagcagattatttagatgacccaaaaggcacacaaaggacactacaatttgggttttataaaatggactaaaaatagaactctaagggcgatcctgtgtcttatagccaagtaaacctctgtataaattttgagggtagacctgtagaatttaaaggtaattaattccgtaaacatcaggtgcttcctttaaatccagaagcacttataattaacagtcagcaacttggaaaacacatgtgtaaaacatacttcggtggattactcagaaagtactggagtcatggtctttgaacttcaaatcttaccaactgatgcctcaaaatctgaaacctacatgcaacatttgatatggttagagatcatgtatgtgtctacagtcttattagaaatagtggctcatgaagactgacagtggggcagggagtgtgcgtagcacaggcatcttactcacacccatgctgagcatcactgacctacatcccacagaaaatagaaactaaatggtctctcaccatttgattattcactcactcaaggtttccttggagaaagatttaaaaagcacttattcattaagggccagagaatcccagcctgggcaacacagtgagacctcatctgtataaaaaaaattttttaacaaaacaacatcagtcaggcatggcagcttgtgcctgtagttccagctgctcaggaggctaagttgggaggatcacttgagcctgggaggctgaggttgcagtgagctgaaatcgcaccacagcaccccagtctgggtgacagagtgagacttgtcactctgtcagagcgacaattcaaaaattgacagtacctaagaataggcattcaggtctccacacagaaaaactaacatgaagcagagtgcccgctccctttcttagtagcaatgaaatctcaattcagaggttttcagatgactcaggccagggtttcatgatttatgataaataaatcatgtaaaacagatgatctctgtatcctatgcattctatgcaacaggatcagagtatgaaagaaccagaatggaaaaggattttaaaatatctgacttaaactcactatttttataagaccaaagataggtttagaaggtaagggatttgctcagaatctcaccaatgctgtaagagctggtattagaacctgcatccgtgcttcagcatatttcacaccaactgatgggtgttacaaatgtgttatgtatttattaaaagcagacctttacaaaagcatctgaaaatcatgagctattggtttaaggatttatactcaaaagttataattcaatatggctttgtctcagtttgtttctgtatctgacagtctataagttggctgctgggacctgaactacatttcaaataacctttatataagaattctattattaaggaggcagtattgttacccctgtgttattaaaaacataatactgggtcaggtgcagtggctcatgcctgtaatcctggcactttagtaggctgaggtgggtggatcacctgagatcaggagtttgagaccagcttatgcaaaatggcaaaacctcgtctctactaaaaatacaaaaattagctgggcgtggtggagcacgcctgtaatcccagctacttgggaggctgagggaggagaatcacttgaacttgggaggcagaagctccagtgagccgagatggcaccactgcactccagcctggttgacagagcgagactctgtctcaaaaaaataataattattataatatgatactgtggaaacagacaccctacaatttgcatgcctaatggattgcctaccttcctcaggtgttttcacctcctctggatttggcaggcccaactcctggacatcaggaccatctccgcgctcacacccagtcttcgggtgaacctgttcctggctatccgcttcaggctctggcccttaaaaaaaaaaaaaaaaaaaaaaaaaaatatatatatatatacatatacatatatatatacatatacatatatatgtgtgtgtatatatatatatacatatacatatatgtgtgtatatatatacacatatatatgtgtatatatgtatatatgtatatatacacacatatatgtatatgtgtatatatacatatatatgtgtgtatatatacacacatatatatgtgtatatatatgtgtgtatatacacacatatatatgtgtatatatgtgtatatatgtgtatatatacacatatatatgtgtatatatacacatatatatgtgtatatatacacatatatatgtgtatatatataatcaatttaagcagtaaaacatgaaatatgaacaagaaaataatattcatgctctcagtgttattaaataaaagctttcactagtgtaataataaatgtgttgataagaatcccaagaacatgatttcaggagtctgttggcagaaaacaggaaaacagggttttccaaatattaccctcttcctttccgaagactgccctcagacaactttgttgctgcctttgcacttctttattattctacttctgattgtccttatcatattaaatgactcaagactgaaaccctgtctctcacagcacttacactcctggcacttagactcctacatggcatgagtagccaccaataaacgctgagtgaaaaaagttctttaaaaaatacatgaaaaatccccaaatcctgaacattctgcacaccaacttgtctatcctcttcaaaaatgtccgtatcctgaatgacaaagaaaaattaaggaaacattccagattaaaggaaactagaaacacatgacaagcacatgtaagacgtgatcttgaactggactctggatcagaaaaagaaattctataaaggaaattatctgggccaggcatggtggctcacacctttaatgccaacattttgggatgccaaggtgggcagatcacttgaggtcgggagttcaagaccagcctggctaatgtggtgaaatcccgtctctactaaaatacaaaaaaaaaaaaaaaagaaacatttatttgtcaggcactgtggcagggctgtaacctcaggactttgggaggctaagctgggtggatcatctgaggtcaggagttcgacacctgcctgtgcaacatgacaaaaccccgtctctactaaaattacaaaaattaggtgcctgtggtggcatacgcctgtaatcctagctgctcgggaggctgaggcaggagaatcacttaaacccagcaggtggatgttgcagtgagccaagattgagccactgcactccagcctgggtgacagagtgagactccatctcagaaaaaaaagaaaattataatactgtggaaacagacaccctacaatttgcatgcttaatggactacctaccttctgcgggcagtttcatctgctcttcatttcgcaggcacaccctcttggtatcaggaccatctccaagctcacacccagtctttggctgaaccagttcctggctatcagcttcaggctcctgcccttaaagataaaacaaaattatcattttaagcagcaacacatgaaatatgaataagaaaataatattcatgctcttggtcttattaaataaaagctttaggtactgtaataataaatgtgttgataagaatcccaagaacattatttcaggagtctgttggcagaagacaggaaaacagggttttccaaatattaccctcttcctttctgaagactgccctcagacaactttgttgcctcctttgcacttatctgttattgtatttctgattgtccttattatattaaatgactcaaggctgacatcctgtctctcattagcatttagactcctagcacctagcaagttatatggcatgagtaggcaccaataaatggtgagtgaaaaaacagtctttagaaactacacaaaaaagcccaaagtgctaaacgttccgcaaaccaactggtctatcctcttgaaaaatgtcagtatcagccagccgggcgtggtggctcacacctggaatcccagcactttgggagaccgaggtgggcggatcatctgaggtcaggagttagagaccagcctggccaacatggtgaaacccaggctctgctaaaaatacaaaagaaaaaataaattaggcaggtgcggtggccattgcctgtagtcccaactactcaggaggctgaggcatgagaatctcttgagcctgggaggcagagtttagagagagccgagatcttgccactgcactccaacctgggcaacagagtgagactccgtctgaaaaaaaaaaataagaaagaaaaaagaaaattatctggataactggcaaaatctgagtatactctgtgtattaaatgactgcaggttctcattgttaaatgtcctgagtttgatcattgtgcagtgattatccaaggaatgactttttctttgttctgaggatatataaacactttcaagtacttagggtaaagggccataatagctgaaaccttatctgaacaatgcagcattaataagagtaaacataatatccgtaagtgtgtgtgtgagtgtgtgggcagcagggtaagagagggagggaagagacatgaaaacaatggagcagaagctattaacaattggtgaatctaggtgaaaagtatatgagttcattgtactattcttgcaaattttctacaaatgttatgtcttgaaaatatataaagtaaaaacttgtaagaatatatgacaactacactgaactttaggaagacagaagttttttttttaattgtgttaaaaaatacacataacataaaatttaccatggtaactaattttaagtgttatagttcagtaaggagttatggttgcaacattaccagcagctaagaacaaactttacatgtttgttttcctatataacgaaacatttattatttatttatttatttatttgcgatgaggtctccctatgtttcccaggctggtcttgaaccctaggctcaagcgatcctctcacctcagcctcccaagtagctgggactatgatttcacagcactaagcccagtttgagacctttctactaaatgacaatctaaggataaaccacaggacatgtataatacttatattcggccatagagtaccaacagcagtgtgcatcagctgagaaatctgaagtctacatcatggataggatttcagttacaattacagtgtcagtttctgaaggattgagcagctggatggatttgaggactatggaaaatcttacagtcacgacacccattgtctactggggtaaacagaaacttaactttgttcaaataaagttatatttaggtccaaaggtcctaaatgtaatattccataaatgaaccccatgtagaacaaagcaccaaaaataacactatttgtgaattacagcaaatatactgtctcacgctgagaacaaaggaatgagtggacagcaattaatgggcattgttgtcagtcttattctagatacctttaacagtgaatccttagaataatccatgacctgagttagataattgttttgcttcaaaatattttatctcggagaaattatttccatctcatgttaatctcaggataattccttttttttggtttttctaaccataaaaggatttaatcacctcctaaaagccacttaaaaaatcatactacaccagctacctgtatggcagtatcctgaattctccagctttcaacaaacttaccacataaaaatatcaaaggaaatggtggccagcaatcaggaactcagtttttggagttgctcctgctcctctgaactgggtctattcctgggccagtactaagctacattacagtaaagcatttgagttttaagcactttcagcaaaatcatttactattgttacagcaacatagatggtaggaagacacaaactttggaacaaaacacaaattttgtattcaccagtcaagtgttcttggacaaaacacaatccccgggcctccattctctcattcataaagtggagaaattttatcatagtgagggatttatttccctaaggtaagctgcaaactataccctcttcacttttccagtcaatttctaggcatcgtttgcatggctttcattcctcctgttcctggtatgtgacaatgcatgagacacacacacacacacacacacacacacacacacacacacacacacacaccccaacaggcattcttcttccctttcccttcaccttgagctgcagatgctccctcatcctctctctcttcagcaggtgtagaatcctgactttgagttggtgattccacttcgtcaggttgctcatcactggactccttgtggtagggaatatgtgtgtgagtgtgcaaagacaaaaagttttgttattaatacatgtcaaaaaatatatacgtatacacacagagaatgcatagatgtttctgatcataactaaacctaaaaatatttctccaactttattctatatggttaataaggctactctacccacagaaaggttactgcgagaaaagttacccacaaggactttggaagctattgcactctatgttggaatagatgtgtataatctatgtgtcattcacaagcaaagcatgagaaagaagtcatggccaaaagttggagaacacaagagaaaaaaaaaatcctcctgaatcaatatttccttcatgagataccagaatcttatttttttaatcagcatgaactacctttattagtgtatctatactaatgcaacaacactatcacaaaaattaatttctgctaatagaaaacatcgaattaacgttaaagcactcaacagcataggcccaattacctcagaagattctacatagatcattggtctacgccgatagattaatcttcttagaaaacccatatttcacactgaaaagagaaaattgtgattgggaacatgcacttgagaggacagctatattcgatcacttccatggctaaatgttaacttgtcattttaattttgaaaatactctcaaaataagtcccagagttaagtgcaagtgtgtacgttttctgagtgcttgcaaagccacttatgctccccaagctggcagagtagtcatcttaaggcatgtggcaaaaggcagaggacattattttaaaatttcttttagacacagaatctcgctctgttgctcacgctggaatgcagtggcgtgatcacacttcactgcagcctcgacctcccgctcacgcgatcctcctgcctcgtccggagtagctgggactacaggcgcgcaccactgcgcccctctgacagaggacgtttctgatgaggtttagtttcacaagcggactccacatgaaaacactagtgaatcacaattcccgtgactgctgcttttggcacactcccacttactagagccattcacccccctcaaatcaagtttggttgggccacacagcctctcccagtccttcccattgtttccggaccttctatggcagaggtgagaccttgccacgcttctcactcgggtgtttctcactcgggcactccccactccacaccgctggggggcgctcaccagcccacagccttcccaggttccaggccccttctttaccgccatcttcaccacccacctcccgcctcggggccccattcaggactcaggaatgtgccctgtgtcatgggttcctaccacctcgggactttgacccctccaacagcacccgcagcactcgcctcattttcacctgagcccctgaccgcttccccttcatggcccactttcctccctgtcctggccccttcacgaccacaaagccgatggcggcgtcgcagcctgtgaggagaaggaggacgagctcgaggcccttctcttttggaggccactgaggcccttctccctcaaaagccacacaccaccagaccgaggggcccaccgaacctgcccgaagcccactggctccgcctgaagcccactggctcctcctcaccctcactcacacttcagcccctgggaggactggcctgcggatctaccagatgagtctcagtagaggaaaaaagtgtccggacagcaggaacgcgactgcacactctcacagctccctggcgttctccacgtgggcgaaggggccgacgggaaggcacccagtgaacatgcgcactgaggctagcacccaaaggtggggagggctgcagttcccagccccacaccccacactcccgattttcatccccgtgaagataatggaatccgacctccctctgctgtttcatatgcctcgggtactcaaatacctcaaatagtgctcccctcaaaactcattccatcttcaactgagcccccctcccctccagggccctctcttgctctggccctgccatagggacaaggaccatggtggctgcctgtgaagtgaggtagacgacctgctaaaacagaaatagcaacatacctcatagcattatacaagactaagagtctcataactaaatattaaaaatgtctagcatataattcaaaattactcagaatatgaagaaccaggaacatagggccactgaaatagggaaagacaatcagcagacatcactgctaagatagagatgttgggattatgtgggaaagcctttaaagatgctattttataaacgcttaggctgggcgcggttgctcatgcctgtaatcccagcactttgggaggccgaggcgggtggatctcttgaggtcaggagttcgagaccagcctgaccaacatggtgaaacctcgtctttactaaaaatgcaaaaaattagctgggcatggtggcgcgcacctgtagtcttagctactcgggagtctgaaacaggagaattgcttgaacccaggaggcagaggttgcagtgaaccgagatcacgcgactgcactctggcctggacaacagtgagactccgtctaaaaaaaaaatgcttaaacaagcaatcatgaacactgttgaaacaagtaaaaacaaagtcctggcacacacacaaaaaaagaatatttaaagaagaagcaaatggaaattttagaagtggaaaatatgataacgaaggaaaataattctccccaaatggattcaatagcagaatggagacaagaaaagagtttgtgaactcaaagatagagaaatagaaattgttctgtgtggccaagagcagtgacttacaccaataatcctagcacttttgcgtgctgaagtaagaagatagatggcttgaggctaggagtttccaacctgggcaacatagtgagaccttgtctctacaaaaaaacaattaaaaatagctgagtgtgatgacacatgcctgtagtcctagctactgtgaaggctgaggcaagaggatcccttgggcccaggagttcaaggctgcagtgagctatgatcacacactgcagtccagcctgggcaacagagtgagaccctgtgtctaaaacaaaacaaaaagaaattgttgaagtgtctcataacctgatattcaaaatgtcaagcatataattcaaaattactcagaatacgaagaagcatgaaagttaggcatcttggccaggtgcagtggctcatacctgtaatcccagcattttgggaggctgaggcaggtagatcacgaggtcaggagttcaagaccagcctggccaagatggtgaaaccccatgtctaccaaaaatacaaaaattagctgggtatggtggcgggcacctgtaatcccagctactcgggaggctgaggcagagaattccttgaacccgggaggcagagtttgcagtgagccaagatcgtgccactgcactccagcctgggtgacagagtgaggctccatttcaaaaaaaaaaaaggaagttatggaatttcaaatggagaaagacagacaactgacaccaatgcaaagacagagatgttgagattatctgggaaagcctttaaagatgctagtttaaaaaagctataaacatccatgtccagacacaagttttcaactcctttgggtagataccaagaagtacaactactggactgaatagtaagagtttgtttagttttgtaagaaatactgccaaactgcctttcaaattggctttaccattttacattcccaccaacaacgaatgagagttcctgttgctccacgtcctccccagaatttgttgttgtcagtgatctggattttgatcattctaatagctgtgtttttggtgcagttttcatcaaccctggctgcccattggaattgcctggtagaacattttaaaaatgttgattttcggctgggcacagtggttcacacttgttatccctgcactttgggtggccgaggtaggtagatcacctgaggttaggagttcaagaccatcctggccaacatggtgaaaccccatctctacaaaaagacaaaaattaggctgggcgtggtggctcatgcttgtaatcccagaactttgggaggctgaggcgggcagatcaccaggttaggagatcgagatgatcctggctaacacggtgaaactccatctctgctaaaaatacaaaaaattagccagacgtggtggcaggcgcctgtagtcccagctacttgggaggctgaggcaggagaatggcatgaacccgggaggtggaccttgcagtgagccgagattgcgccagtgcactccagcctgggcgacagagcaagactccatctcaaaaaaacaaaacaaaacaaaaattagctggacatgatggcagatgcctgtagtcccagctactcgggaggttgaggcaggagaattgcttgaacctgggaggcagaggttgcagtgagccgagatcgtgccattgcactccacccttggtgacagagtgagactccgtctcaaaaacaaacaaacaaacaaaaaaaccacaaagatatcgattatcagcctccaccccaggacaattaagctgggtctggggcttagtcatttattcatgagcatttaaaaagtatttctcaggttatttaaatgcgtatctggtgttgaggatggctagtttagaacatatattaccaataggcctttgacgaagtgttcagagcagtgagaaaggtaagatgtaaagcttttaccatcttaaagtcaaccagcttattggagatggcttgatcagacacttttggaagaccctgcttgagataaatcaaatataagcaaagtagtagtagatgttgaagcagagacagctaaagggacattagagctgcaatttagggcctttcagggttcccccagatgattaaaactaaccagaggccataacaatcatcttttctaagactatagagagaataaaagcagaaggaaagggagaaaaaaaccataactattttttaaacctttcctaaacccttagcatattttgtagtccttactctatcacctgaactagtctattttataaagcggcctggataacctttaaagtcctctatgtgggtctctatcagcatttgccagtcataactaatggactgagatagaagacacagaagctgtgcctgtagaagaacataagacaatgacaagagaccaaaagcaggtccattttgtacagctgcctgggggtgtacatttaggaggactgcaaaagttagaagacataccttacttattaaaagtggtaactagaaaatgtgcccctaaggaaaatcagtatttttttaaagtataccattcagtatttttagtatattcacaaaagttgtgcaaccatcagtactaattccagaacattttcatcacccctaaaagaaactctattttctgtctttatggattttcctattctggacatttcatgtaaatggaattatacaatatgtagccttttgtgtctggcttctttcactttgtgtaatgttttcaaggttcaaccacattgtaccatgtattagtatttcattttttattattgctgaataatattctattatattgatgtaccacattttgtttaccaattcatcagctgatggacatttagggtctttctacttttttggtcaccgtatataatgttgctgtgtgtatttgtgtgcaattttttctatggacatatgttttcatttctcttgagtatacagctaggagtggaattgttggatcatagagtaattctatgtttaacttaaagtgccaaactattttctacagtagcttccccgttttacattcccatgagcaatgtataaaggttcttctttctctgcctcctcagcaacacttgttattttccatctttttgattatagccatcctagtgggtttgaagtagtatcacattgtgattttgatttgcatttacccaataacgaaaatgtcaagcatcttttcctgtgcttgctgaccatttgtatatcttctatggagaaatgtctattcaggtcctttgcccaaccatcacctctgctgcaacctttatagcaggttaaactaccacctctgcaacagctatcttgggaattcaaaccacaatctccgcagcagctggcccagaacagtcagatcttcatcaacaactgccctatatttttgccccagcttccaacttacatctgactggagaaagccaaatctgctccccagaccaatcacataacatgtctaactcctagttagcccaccaatagcctccaaccagggcatacctgaagctctttcccactcccctgcctgcctttgaatctctgccaaccacaaatgatggtggctgactttctttctgtagcaagctctgaataaatagcctctgtttgttctcatttgggtggtcttcatttatttccacagtaaggttgccagataaaggataggagacccagttaaattagaattttagataaacagcaaaaaattctttatagtataataaaaaaaaattctttaacataactatagtcgtgcatcacttaacaacagggatattgatatagtttggctctgtgcccccgcccaaatctcatgtggaattgtaatccccatgtgttggaggaggggcctggtgggaggcgattgaatcatgggagcggatttcccccttgctgttcctgtaacagtgagtgagttctcacgagatctgatggtttaaaagtgtgttgcacttcccgctttgctctctgtctctctcctgccaccacatgaaggaggtgcttgcttccccttcaccttctgccatgattgtaagtttcctgaggcctcccactcatgcttcctgtatagcctgcagaactgagtcaattaaacctttttttttttttttttttgagacggagttttgctctgttgcccaggctggagtgcagtggtgcaatctcggctcactgcaacctccgcctcccaggttcaagtgattctcctgcctcagcctcctgagtagctgggtttacagtgagaatggacttcatcattgtgtgaacatcatggagtgtacttatacaaacctagatggtatagcctactacacacctataggctatatggtatagcctattgctcctaggctacaaacctgtacagtatgttactgtactcaatactgtaggcatttgtcccacaatgctaagtatttgtgtatctaaacatatccaaacataggcaaggtaatgagttgtactatgatgtcattatggctatgacatcactgggtgataggaatttccataatgatgtcactaggttataggaatttttagctctattatcatcttatgggactgctgtcacatatgtggtgcattgttgactgaaatgtccttataagatgcatgactgtatgtttcaaatattgcacaattgtgatttgctatacctggaactctatgcatatataaaaatgcaagctcatacagaattctgagaggtatactgctttcttaacaaaaggcagctggatagttctgatcagttgagctctgaggtttaagtgacaattaaatgacatttctgttttgttgtgttgtgtttctgtaccaggccagagcttatctgccaaccaatacatgctgtgatgtacctttatcaagctgggggactttcacattattgtctcggctttagctccaatacaagacatttcgttttaaaagccctttgctccctgtgtgttaattaaagtcatttcagtggtctctgctgccagtttcctctgctcttcaatctgagtaatgttaattcagtcccagagtcccctggagattcattcaagcttcattcctgatttatttctgtcctgaccagatggctccaggttcctgcgactgcatgggcatcttttggattattctgtttatctttcccagtgcccaagataagggtagagtctaatggagtgcatttgtcagcaggataagccattcaccaccactgctgcttgaacaccataaccaaagttattagatttaatatatgctttcgtaaactccgtagcaaaagctggtgaagggttgttgatttgttttttgatcttttagaagatgcagccaatggcggggcagtagctggcaggactgagcagagaggaagggggactctacagggagctctgaaggctcctgagtccttctctgcctttaaggatgtggaaaagatagacatgtcatgaaaaagatagacagaatatctttaatgaagctaataaacatgcaaaagaagatgtgatatttaaagaaacagtacatcaaaactgacaaatgcaatctttcactgtgagatcgaattcaattcacccaaagggcacacttgacttttgttaaaaaatacttgccttagatttcaacacagtgaaagctctcatataagccaaggctaaagctgaatatgctctggttagtgggttttgcaaccctgaaaaacatgcaggaagccacacaatacaaagatttggcatttggacttgcacacatgtgcgcacgcgtggacgcacaccagcaaacatacaatccagtaattatgaattatcatcattagggatttcagccaccaaaagtgtttgttgttcagaatgccgtaaggatgcacaattcacacatattttcagattgttggttctgattcctggatcagttcctcttatggcctacccatgcatacaatgcataatcctggtgggctctagaagcaggggttgctaattgtcctttatcctagagaagccaaatgaagaatttctggcttttggttctaactagcctactatgtacctttttttaggctggccatggggaaagcaaaggttaataaagcagtatgcttgcctcagaagccaattagaggcttttgcctacaaaagcaattataatgcaatgctgtctgtgaagagtgctataaaaggtaaaaaccttgcaatcgagtggtgagcaaattaatctgggaagtctttgcagatttaatctagaccttgaaaactggaaacggcagtggcaggttgatgtgttctgtgtaggtttggagggtaaaggtggagggaacgggctgtagtacattcagcataaacaaaggtagaagccagaaagagcaaggaatctgtgaaactgggagcaaagtggtattttctaacatggttggaagagaggatgtgagagaacagagactagaaagacaatgccaataacaaataactgaaataataataactattatattttgcctgctttgtattggcactgtgctaagtgcttttcacccattatctcatttaaagcacacaactcttgcaagtaggtattgttatttctattttatagatgaggaaactgaggaacagataatttatataactcaagatttcaatctggggcaggggtgagggtgtccaatcttttgccacattggaagaagaagaattgtcttgggccacacctaaaatacactaacactaacgatagctgatgagctagaaaaaaattgaaaaaaaactcataatgttttaagaaagtttacaaatttgtgttgggccaaattcaaagccatcctgggccgcatgtggcatgagggccataggttgaacaagcttgctgtacggtattgcctataacatgtgctgaagaactctgttggggcatcagaagggagctgagatggagggttctgattacctggtgggcctgactctgctcctccttaccttcatgcactcttacattaactgtcctcgccctcctttgtccttctgcagtttattcaaattgtgaagtcccaccatagccatgttcttgacgtattgtgccatgcgtgtattttatctctctgactcatcttctgtttccttaaaggaagggatcttgtctgtcctttcatatcttccccagggcgaggaactgaaaacacatatgatggttaattgattgattaggatttcactaagcattccacttaggcacttacctacctgtaatgcttgttgactgcttgattgaacaccttcctcattaactccatctggacaggcaacttttctgcatatgtgccagatccagtgctaggcactgtcactttcatgatttcacttaattctctctagatgtgtactgtgcattcccatttcacaagatgagtaaactgaggttcattgaggttaggtggcatgtttcaaagaataactcaaaggcatattgttagttattatcaagctaacttacttgaatacaaaatactaataacagattgatttcatctaacaaaggatttatctacaaggaagaagaagagagaggtaagaaggaaaaccacaggcatatttgaaaatggtgaaccctgctttcctcttgctgggcgaactggtgaccagcaaggggccaagtgggctgttctgcccttggacagcagactaggtcctcaaagaaaacaaattcggttgtttatgggttccccataaggcctcggaagtttagctatgagcaatgtgtgacaggctgtctctgtgttttggctgtcactgtctttagttaacaccttcatctcagctatgtcatttgggcaccagctcccttccagaatttctcaactactgcctcagtcactcagcaaccaagccgggctgactatgaaggtttcaggttccttttgactctgatcatgggttaactgttgttttgagatcctggctgtgcaggcacatttaggcagttggagttagacggtggaggagggcaaaaagcctaagttcaatcataataataaatatcgaaactcacttcatgtccaatgttttagtttcccaaagcccaaccaggagagcaatttgggcttcgtcaaacttgccaaaggattagtttggccaatattagataagcaagtggctttttcattcattcattgatttattgccccatttctcctgaagtatttatccagacataataaaatgtgtcacccattgccccgacttcaccttggcttgtgagcaaataaaaattctaagactccagcttggctggtgagcaaataaaaattctatctgatagatttacgcttaaatgttctgcttctaatgcttgagctatttcatttgctatttgagccaaagtctgatataaattgtggataacatgatctatttcaggaactcctgctcagagtataaatccttgcacaaatcagtaaaatacagtatcatggatacctcctggtaaggtaacatgtcaaaatattaataaaataagatcactgggaggttctgttttgaatgtttggaaaggctgaatgaatatactgaaagtgtacagcatattttaatgcagcaagcatagaaaatccattttattacacccaaagaaagtcccagaagtgcacattgagaaggcatatatgtgttgtttatggtaggtaccacttattgtctgaatttaatagatctgattgttgacgaaaacactctagagttaaataaatcatttatatagtttttgtttagatttgtggtaaaataattggactatagtttgcatcattagtctcatgcctatcctattcttgatatttccccagtttctttgaaagttcttggaaatatcagaaacaacagttaattgttaatgacctagtgtcaagttaaggcatatagatgtctcaaggttaatatttctgtattgaagatagaagggaatgacatggtcagtcttagggtgaaatctgataccatttagtcctataggcatgggtataagggtcttactagaacatctggggctggatgagaaatccagcagctgaaaagattggctgttgttgcagttgtttgagaaaggcaaattcacagagtttctggaaaatgaaagtgttaaaaaaatggaaaaaaaagagtagggtgaccattttaacaatctagtatcttgagataccacaaaataaaaacaataaagggaaaaagaggagtcaaataataaaatgagggtctgttgccctgattctggatcttaactagaaggtcttgggagagggctctccacttcaggaagtctttgcttatgcagtcctttttgatgactctcagagttaagtctctagtgggactggagagatgtctcagtggtaggatacttaacacactgacactggcttgcatgtacccatggctacacagtctggagttaaaatgtagtacttgtagttaaaaggacctgaaatggtcttttctagtgtgcctcttcttcttcttcttcttcttcttgttcttcttcttcttcttcttcttcttcttcttcttcttcttcttcttcttcttcttcttcttcttcttcttcttctttttcagagacagggtttcattctgttgcacagggtggagtgcagtggtgtgatcatagctcactgcagtcttgaactcctgggctctagcaatcctctgcctcagcctcctgagtagctgagactacagtacacaccatcatgcccagctaatttttaaagttttttgctatgttgtccaggctgatcttgaactctcagcctcaagtgatcctcccaccttggcctgcccatctagtacaaccaactttcatcagtttctcttccagcatctccagtctcctgactacaaatcatgtaagggtatagctggtaatattctctttgaaaatgcagcttgcacctgttgggcatatgatgtcatttttgacaatatttgacaagcttgaagtgtttacaaggtggaatccgatagaggaggagtcatcacagtctcatgggtcttcctggaattgtttcaaggggagagcctgttaagattttgagatgagatgactattgcctatcgttacagctgatggttagagtttaggtcaggagagattaaactcttctgagtattatgagagatcattggcccattctattttgcaaaaacttagtgagtggatcaatgtgagcaaggaagtttttgttttaatgggagtactttacacagtttcttaagtatttccacctgtaaagtgaaattttctatcactagagagtaatatatgtactctatcactagagagtaatgcaggtgggaaaaaacaatatctatcaatctattatctatctatctatctctatctatctatctatctatctatctatctatctatctatctatctatcttttcaccttttagcaagggaaaactttaatccaagtataaacctaacgcaccattataactgaatgaaatccatttggaaatgttcaaatggtttttgaggcaaaggttctgaactttgcctttttctgcagcttttcctgggtcatgataacaacagagaaggcaagatttggccacctgtctcaaggaagatttttctcagcgagatttttgaaaaatttgagcaatttgtcattgtgaataatttcacagagaaagcactaaaggtctggagatggcctctggtgacattaagcactcatcctggcaatgccaaagcccattattgcacatgtgacagtttggagaaggccactatttcttttcttctgaagtggcaggttatcatatttgaataagtcattcaggattcattaaatcagattgagtaagtgtctttagaatacctactgtagcaagaacagaaaggactgcttattttacataatagtcagaaattcccttttgctttaaaagtactacctttagaatgagtttctccatttctaatctatacttcatttggatgttatattgcctcttataaattacttttttttccattttagttggggtgcctggtgagattagaaaacctctttgttttcataatgtactaaaaaaatcatgagcaactccaaagatacatctatttgtatagatgtgtactcaagtgtttagcaaggtgacatgctggtgatgtaactgtcattcagctatttgagtggagtgagctattgataaagaacagctataatagcagaatagtcagaacttatggcatagccagcacaaaatatgcttcgcttattctcaagatatgagccatcaacaaacatcatatcagagttttctagccagtggttctcaaggttttcaacctttagcatgcgtcagaatcacctggagggcttgttgaactacacaatgctggtttccacttccagagttttgaattcagaagatctggagtggggcccaacaatgcggatcccagaaaaagtgccagatgatgctgaggctgctggtctggggactatactttgagaggcattgctgtagaagagcatcaagtgtcaggctgaagaatactgagagtttaaatagctgctagacattcatgacattcagtcattcaaaagaggaagtaggatatcagcacttggattagaacaatatttaacagttttgggtgaagcagaacataacagaacttcatagaaggcaatgagactggctgacaaccattgagtgttattctgaagtaataagatttctactcctcaggaatctctagggtgagggagaggcaaagaagatatctgctggagcttccaccaatctagctgctgccccatggcatataaacaggggggaacaagcctcggccacacggccagagacataagtgatgatcttatgataagctcctgatttttgagtaagctcatcaaaacgaagtcttgcctttcgtaggaagagcttagcagagttgggaatgctcaaaattgggtttgttgcaaggcttgcttaagggacgaaaagccctgctgtgatctgaatcccaaagcaggttctctagaatactggatttgtaggggaggaaaactaattttctctctaccctttgttgacaaaaagagtcaaactgtgtaaaatatttgaagagatttattctgagccaaatatgagtgaccgtgacctgtgacacagccctcaggaggtccaagaacatgtgcccaaggtgatagtggtacagtttggttttatatattttaagaagacatgagacatcaatcaaatacatttaagaaatacattggtttgattcagaaaggcgggacaactcaaagcatgggggtgggggagggggaggggagggggagggggacagggggtaagggggtgggtggggattccaggctatagataaatttaaacattttctgattgacagttggttgagtttgtctaaagacctgggaacctgggatcaatagaaaggaaacagttttatagtggctgcccttagagacaatagatgaaaaataattcctattcagatctttaaaaggtggtagactttagttaatctctttaggattgggaaggcctggaagaaaaagatctagctatgttaatagagattctttacagatacagattttcccctacaaaggacggctttgcaaggccatttcaagatatggcagagaaacatattttggggtaaaatattttgattttcctccttgtctcgtaacgttatgccagggtcaggttggaaagtaagccatgatatatagggttaaataaaacccatctgatgagaatttatggtttgtagggcatgattccccaggccccttagataggaatttgggcaagattaaaaaaaaaaaaaatcagagcttagtcttcaccttcataattctcaattgggatggacccctgtaacaaaagacagatgaacaagagaaaaacaaacagaagtttattcacatgtaaacctcatgtatatatgagagatacccagagaaatgaataatctccaagaggtggcttagagtttagtcttaaatgccatcttcaattaaaacaaagaaagaatggtgttggggaggccagttatgagatgactaggaaaagcaaggaaaacaagggcaagggttgttatacagatttaagtctatgccttccccattgataagaatctctagtgatttacggtaatcattttcttcctggtactgagagagagagagacacccttgcaaattgagatttcatttatacatgtaaatttcccttataaagcagtaacttctactctgttttcagagcttttcctgtgtctgcaatttctcaaaataatcagctcaaaataatcattatgctaaagaggtatattctgtagtacctgactataagatgtgtcttcagcagctgttttttaaatgattatcagtgttttcttccagtattctgatcattaaactctaatgtaagtgccttagcaggtactgatatcataatattaaccaaacaataattaggatgtattctctgtctttcagtataccaaatataatatacttgtgaatggaggcatgtcatatatatgaatccttcacttatgtgaagtacatcttccaacaatacattatattttgctctacattagcagaaggtattattcacagttccaagcccttttctatagacattcattgcttttaaagtagccagcaatataatcactaattttatttggtttacttaaaaaaatcctttccctcagctactcaacagctattcctcactcttctgtcaacatgcctatttctaagagcctacttcatgtaattgcttctaatttgctataggaggagactagacaacaagcttgttagtgagtgttgtgtaaggggaggaattccaaagtctgaatgagggctcagggcaatgaaataggtcagctttagagcactggctttgttaatggctgttttctgtgctcctctgccttttttgcatgattcctgccttctgcctctgcctttgtggaggtggcggtcaggctgacaccttagaaggatgttactgcaaacataaattccacacagagtcttatgcaagatccttgtttggatataacaaagaaacacatgacttaattcttgggaacttgatctaattttagatagtaaatcctcataagaacaaagcaacaacatcacagatttatcacacataaagtggttaagcactaaaggaatacatcatgaagattttctggaagagatatgtattaaatcaatttttctttgaaaaagtgagagatatgcttcggtgagagtcagagaaggctgtaaaaagataattttcagaaaaaggtaaaatcatgactctcataaagatagaaaaatgaactcatgttaaataatttattttactcctgtcaaagagaaccagagccttacagactggcactttgacatgccaagaggccttaggggctgcttcacattcaaggttcctctaaccttctcttgtctccctgttgccagaaaggagtcccgattcagatcccaagagagggttcttggatcttgcacatgaaataatttgaagcaaattcataaagtgaaagcaagtttattaagaaagtaaaggaatagggctgggcacggtggctcacgcctgtaatcccagcactttgggaggctgaggtgggtggatcacgaggtcaggagttaaagagcaccctgaccaaggtggtgaaaccctctctcttccatttaataaggagattgcatcattgcactccagcctgggcgacaagagtcagacgctgtctcaaaaaaaaaaaaaaaaaaaaaagagagaagggagggaaggagaggcacaaatgagatactggtttaatgggatcctttaccactcagctattgactcgattttcctctccacagccaccaactcagcttttaatgtatgaaacttctagggtagtttcagacaggggaatgttaaggctcagaaggagatatcctaaagactagtgctttgacatgctgagaggccttagaagcgccttagaatcgaggtccctccaaccttgtcttgtaccctcatcctcaagcacaggaagtaactctctctagaattttttttttacttaaccaagaaaggcttctttgcaaaagaaacacaattgccttcttcccctccctgaaatctcattatctatcatgcaaccacatctggatggacttttccacaaaataatgcctgcctcttgggctcatttaagtttcaaatagaataatttacaagttaatttctatttattcattctctctaataattatatgctgcccctcaaaagaattctctacattccttatctgctttctccctctatgaaaaagggtatataagcttctgctagaatgtgcccatattaattttgctcaaaagcttcctgaatgcagccaagaatctttgctaccccttttattaaaaaataactttgtaattaaaaaataatttaaatattttcttctatggtagaattcccaggagaaccttcagttttataggatttggggggagatttatgaaaaaccactgggtcatttttagttaggtgacatttgtcctttcattttttgtgaatagtgtagtagaagcaacatgaaactaagatacaaagccagaaggctcaaatgccacatgcgtgtctttggctccatttagaccatagtcacagagtgctcttggagtttagatgacgccctataaatagtgtggtcagctacagtttgagctcagacctgacaaagactcactccttggccaaactttagacaggctcctttgagtcctttttgcctactaggacttgggtcctgtctaccgcctgcctaggctatgtaggggaggaaaactaaactttttcctctacacatcttagattcattgtctagggccccataactttgaccatcaaaaaacagattaacaagagaaaaacaagcagaaatttgttaacatgtacatcttatatacacaggggagcactcagtgatgagtaactcaaaggggtggctagaagttagggaccatatatacccaacttagtaggagaaagggaggagggagaaagggtgcttatagaaaagcaaataactttttggaaatataaatggacccttaggagaatagatgggagatatgatagtcttgtgatggtgtgtgtttgagtgtggtgctgacttcttacttctgagaagattgaagttgctcttgggcaggggatttatgacaattgaattttgttgagttttttttcttttttttcttttttttggagactctgcttttaggcatacaagggatttcagaaactcaaatatcttcagctcaaaataatttgtgtgccaaagtggaatgttttgaggtggcatatactgatccacttcattcagttgtagcaagaatgctactaagtcagtttagtgagaattctcccacccttggtactgatcaacctggcctgcctttggcaagattcttgttcaattggtttatcaagaattctccctacctttgagatctcctcttagtaattttctacccactgaccccttcactctgctgagtggctataactccccagctatctttgcagtatttatagttcagcccaatctctatcccctattaagatagtgctgactctatcacaacagtcctgaataaagtcttccttaccatttagaaaaatgtcagaataattttttctttaacagaaaggatgttaacagtctataagttacctattgcttcagcatcttccttttcattaaaaaaatccttttattaaaaaagcctattttcatacaatgtggttcaggacatgctaccccaaaatatggcacattagcatattaaatattttaagatggaggaatttcagaagtccacggaaccaggaagttcactctgacctcccccacactcctgctcttctcgcctgaagcaaggcataaaacctagcaaggactatctttagtaaaacggggtttcaccatgttagccaggttggtctcgatctcctcaccttgtgatctgcccgccttggcatcccaaagtgctgggattacaggcgtgagccaccatgcctggccagttcttttttaaatggttggtaaaattcagcaatgaagccattggatcctggccttttctttgctgggagactttttattacagctttgatctcattacttgctattggtctgttcaggttttgcatttcttcatggttcaagttgagtaggttgtgtgtattttttatcaattttttctaggttttccaatttattggcatatagttgctcgtagtagcttctaatgattagaatttctgtggtatcatttgtaatggctcccttttcatctctgattttatttatttgggtcttctttttcttagttggtctgaataaagttttgttgatttcgtttatcttttcagaaaaccagcttttagttttgttgatctttcatattgttcttttcattttaagttcatttatttctgcttgatctttttcatttcttctactaattttgggtttggtttgctattgcttttctagttcttttatatcattaggttgtttgtttgaagattttctacttttttgacgtaggttcttattgttaaaactttcctcttagtactgctttcactgtatcccataggttttggtatattgtgtttctgttttcatttgtttcaagaaattttttcaattttcttcttaatttcttcactgacctgctggtttttttgggagcatattgtttaacttccatgtgcttatatagtttacaaaattcttcttgttattgatttccagttttagctcctttttgtgttatttgcttcttttgtcttgctgcttttaggatcctttctttattcttgacctttgggagtttgattattaaatgccttgaaatagtcttctttgggttaaattggcttggtgttttgtaaccttcttgtacttgaatattgatatctttctctaggtttggtaaatgatctgttattaattatccctttgaataaactttctacccaaatctctctctctctacctcctttttaggccaataattcagattagcccttttgaggctattttctagatcttctaggtgtgcttcattctcttttattcttttttcttttgtcttctctgtgtttttcttttatttcctttccttttttagatggagtcttcattctgttgcccaggctcgagtgcagtggcacaatcttggttcaccgcaacctccacctcctgggttcatgtgattctcctccctcagcctccggagtagctggaattacaggcgccctgccaccacatccagctaaattttttttgtatatttagtagagttgggatttcaccatattggccaggctggtcgtgagcccctgacctcgagtgatctgcctgcctcggcttccgaaagtgctgggattataggcatgaggcaccacgccaagcctatgtattttcaattagcctgtcttcaagctcagtaattctttctgctgcttgatcaagtctgctgttaagagactgaagcattcttcagtatgttgattgtgtttttcagctccagaatttcttcttgattcctttaaattatttcaatgtctttgtgaaatttatcagataaaattctgaagtccttctgttatcttgaatttctttgagtttcctcaacacagctattttgaattctctgtttgaaaggtcagatatctgtttctccaggattggtccctgatgccttatttagttcacttggtggggtcacgttttcttggacagccttgatacttgttgatgttcgtcagtatctgggagttgaagaattaggtatttattgtagtctttgcagtctgggcttgtttatacctgtccttcttgggaaggtttttcaagtatttgaagggacttgaatattgtggtctaagtctctggtcactgcaaccatagctgcatttgtggtcccctaagcccagtaatgctgtggcttttgaagactcacagaggtaccatcttggtgttcttgagtaagatttggtagaattctttgcattacatggaagagacttttgttctcttcccttcctttctctgaaataaatggagtctcactctctgtgctgagctgtctggagctgggagaggggtaacacaagcatctctgttgagagacaggaatagctggatttcctaggctgactaagaatccctaagcctagctgggaagttgaccgcatccacctttaaacatggggcttgcaacttagctcacacccaaccaatcatgtagtaaagagagctcactaaaatgtgaattaggcaaaaacaggaggtaaagaaatagccaatcatctatcgcctgagagcacaggaggagggacaatgatcgggatataaactcagagattcaagctggcaacggcaaccccctttggatcccctcccattttatgggagctctgttttcactctattaaatcttgcaactgcacactcttctggtctgtgtttgttatggctcgagctgagctttcactcgcggtccaccactgtgtttgccaccgttgcagacccaccactgacttccacccctccagatccagcagggtgtccactgcacttctgatccagtgaggcagctcccattgccgctcccgatcaggctggaggctcgccattggtcctgcatgggctaagtgctcagggttcgtcctaactgagctgaatggagctataacactcaccgcatggcccaagattccattccttggaatctgtgaggccaagaaccccaggtcaaagaacaagaggcttgccgccatcttggaagcagcctgtcaccatcttgggagctctaagaacaaggaccccccctccccccccgcccccgtaacactgtgactaccaccactgggacagcattgggtcagacccaaagccagcacagcactgggtcttgtgcaaggcccatggtgaccacttcctggttaccacctatgttcaccctaggcccaagggctctacaatcagcaggtggtgaatccagccaagcttgtgtcctttccttcagggtggtgagttccctctagccttgggtgggccagaagatgccatctgggagccaaggactggagtttggaaacttaagaatatacttagtgctctattctactgtggctgagctggcatccaagctgccagacaaaaataaatgggacttaattaaacaaaagcttctgcatagcaaaagaaataattagcagagtaaacagacaacccacagagtgggagaaaatattcacaaactatgcatccaacaaagaattaatacccagaatctttatgggactcaaacagattggcaaaataataataataataattatcccataaaaaagtgggcaaaggaaatgaatagaaaattctcaaaagaggatatacaaacagccaacaaacatatgaaaaaaaaatgctcgacatcactaattatcagggaaatgcaaattaaaaccacaatgagataccaccttattgctacaagaatggccataattaaaaagtcaaaaaataataggtgctggtgtggatgtggagaagagaacacttttacactgctggtgggaatgtaaactagtacaaccaatgggaaaacagtatgaagattccttaaagaactaaaaatagaactaacatttaatccagtaatcccactactgggtatctacccaaaggaaaagaagtcattatatgaaaaagacacacacatgcatgtttatagaagcacaattcacagttgcaaaaatatgcaaccaacttaagtgcccatcaaccaacaagtagataaagaaaatgtggcatatggaatcatactcagacataaaaaagaatgaaatagtgtctttggcagcaacttgaatggaggccattattctaagtgaagaaactcaggaatggaaaatcaaatatcatatgttcttacttataagtaggaactaagctataaggacacaaaggcataagaatgatataatggacattggggacattggggactgggtggggagggcacgagggataaaagactacatgttgggcacagtgtacactgcttgtgtgacaggtgcatcaaaatctcagaactcaccactaaagaacttttccatgtaaccaaaaaccacctgtaccccaaaaacttttttaaaaaaccccaacagagcatttctgtattggtcagttcttgcattgttataaagaaatacctgagactgggtaatttataaagaaaagaggtttaactggcttatgtttccacaggctgtaaagaaagcgtgatagcttctggggagtctcaggaaacttataatcatggcagaaggcaaaagagaagcaggcacatcttacatgaccagagcaggaggacgagacagagaagggggaggtgctacacacttttaaacaaccacctctcatgagaactcactcactatcataagaacaacaaggggaaaatctgcccccatgatccaatcccctcccaccagtcccctcctccaacattggggattacaattccacatgagatttgggcagggacacagatccaaaccatatcaattttcaactgaaacaaaaagaccgtctttcctaccctcttcagtgcctctttccatgatatgatgttaaaaccaggcactgtgatcactcatcttatttttggttcttatgaaggtcctttgttgtgtgtggatagttgttcaatttggtgttcctgcaggatggacaataattggaagcttctactcagccatcttgccctacctcccctcctcaagggctgtttttgagcacctgcttgccagtccttttatgaggcattggggttagagttgtgaatgagactaaaatggtccctgtccttcatagtccttatagactataaagtctagactccagacaaataaaagcctgggcttccattcaggccatctctatgggcaggtgctgtgtattgagatacaaacatgaatgaaagcttttcctagccttttaggagcttcccctggagggaggtgataaagagtctctctccttgtccaaactctactcaggctcctttgaactttcttctcattgaggcccttactgttaggcttctgtgtttgtctctgcatagtctaattttgtccaggatcatggtaagtaaatttagccagaattccccattcttgatatccaatcatccttgctatctgatcgggttcctcattctccaccatcccccaggtgatgtctgatccccctggcttgtcttcagcaagaatcctgttaggtcagtttaaccagaatcttcccttacccttgatatctccttttagtaatttttcatttactggccccccacgccacccgttgggtataaattctgacttttccttgttgtattcagagttacatccaacccttctcccctactgcaaaactccattgtagtggtccccctggataaagtctgtcttaccatctttaacaagtgtcatgaataattttttgtttaacaggaggcagacccagactgacagatggttttattatattaggataacatattaaagaaatatataagaaacagatatatatatagatatagatacatagatatatataatttttagacccaactcataaaggaggtgatgcttaagattgataagtggaaaagtaaaaaaagaatggaaagcatattctaaagggcaagtcataaaaagacttggaggaaagaaacagcagagtgtgtggggagaaatataaaaattccaggataatcgttaaaataaatcacacagcaggaagtttctggagacggtactgagaagcagggaatgcaaagccctggcagttcttgtgtgccaggcttaggctttcacttgtaggcaatgaagagttctcatcacaggagtgaccagattccaggttagcatggtggatgagttattctggctatactgttgtggacaaaaagagtcaaactctgcccttagagacaatagatgacaaaattttcctattcagatctttaaaaggtgctaaacttgtagttaatctcttcaggattggaagggcctggaagaaaaagagctagctatgttaatagagattctttacagatgcaaattttccgccacaaaggacagctttgcagggccatttcaagatatggaaaagaaacgttttgtggtaaaattttgtattttcttccttgtctcataatgttataccagagtcaggttggaaagtaagtcacaatatgtagggttaaataaaacccatctgatgagaatttatggtttgtagggcatgattccccagggtccttagataggaatttgggcaagataaaaaaatcagagcttagtcctcactgtgcaggaggaatttaaaggaaatgtgttggttatcctttctgtactcccccaaaccaattttctgctctttctttgccttgctccctgcccaaaaggctaaccccctaacaggctgcatcatgtgggctttcagatttctggttgtctacagttgtataacaaaccacctcaaacttaatgacataaagcaacataactgaaactgcctttgcaaagttacgactgagacaatgaaagagatttaacttaactgactccatctagcttctaacctccaagctgcccttgttcattcctaggtgtaggcagaactaactttgggaggaacttgtttatagtttatagcttaaacaaagacagtaacagccctttctcaaagcagacctccttcttgcctggggactagactgcctctgtaggactaacattagctacaagattataaattatggtttaggagtcatgcagctggaggctacaagattctgaccctccctaaactgctcctaagatcagtgctggagatattttgtagaccctgcacttggtggatcagctggcgccacccagatcaataaactggctcatctgatcttgtggcccacatccaggaactgactgagcacaagaagacagcttcaattccctatgatttcatctctgatcaatcagcactcctggctcactggcttccccccacccaccaagttgtccttaaaaactctgctccctgaatgcttggagagactgatttgggtaataataaaactatggtctgctgcacagctggctctgcatgaattactctttctctattgcaattcccctgtcttggtgaatcagctctgtctaggcagtgggctaggtgaaccccttgggcagttacataaccatttattattatgatctctcacagatctgggggttgactgggcttagctaggcagttctcagttgagagtctctcatgaggttacagtcagacagcagctggggctggcatcatcctgaaggtattctcactcacttgtctggtgtttgatgctggctgtcagcaatcacctgaaggatactagaatatgccaccccaaaatatgcctctttggcacatgaattattttgagctaaaggccattgagaactaacagatgcaagaaaatctctagaaatggcacaagtttttcttttgtaaaggcaatttacatttataagagaagtttctatttgtgaaaggtgcctccctctcccataccaggaagaggaggattcttaactcttatcaacggagaatgtagacttaaatctgcattactaaccttactgaacaacccttgtttactctacttttcctggtcatctttccataacttgcctcccttgcccagaagccccaaaccccttttcctttgttttagcctaagatggtatataaatccaggctctaaccaccactttgggttactcattgctgggtagtcccatgtgtacatgtgcaatgcatatgttaataaaaacttctatttgtttttctcttgtcagtctattattggcgaacgtgatttacagggccccatctggagaacctaagatacatagaggaaaggattatttttctcccctacagacctctgcaggggcttttggccagaatacttacttacacatgtcctctccaagtggcttaggcttcctcatggctgtgttccaaaggcaagcatcccgaaagtgagagccaggcagaagctgtattgtcttttatggattagccttaatattcatgtagcattacttccactacattctatttgttagagatgagtccttaagtctggcctatatttaagtggaggagaattagactgcaccccttgatgaaagcaatgtaaaagaatttgaaggcatgttttaaaaccactattcctctaacttcaggttgaatttggaccatgtgtgtgtgtggtgaggggaagggtggggtgggaggaagtgggccccagcaaatcagagtgtggttagcaagaaattttgtggatatttatccatccctccctccttccctgcctggctgtggttccatcagtggctgtagttccttatagcctacggctcctatctggtgacccctcttctactgttccagttgtagtccctgggttctactaatacaacttcctccccttgcccctcacatctagggatggtaatggcttcttcatgttgctattccccaagtgtcttatcatcggtttctttaactctgccaaaacctttgggaatggctcattaattcagctctttaaatttgaacacattaaccatctttttttattgtcatgaagctgactaaatcaagggaccaaaacggaggcagagaaactagttgggagtgagttattgttaaagaagacagaatctttctaacccaaactcactatgccaaagtgaaagttaagcttgggaactgagtcatgcaatactgccttcctctcgctccgtcacccaggctggagtgcagtggtgcaatcttggctcactgaaacctctgcctcccaggttcaagtgattctcctgcctcagcctcccgagtagctgggactacagctgggactacaggtgtgtgccaccatgcttggctaatttttttgtgttcttattagagacagggtttcactatgttggccaggatggtcttgaacccctgacctcaggtgatcttcccacttcagcctcccgcagtgttgagattacaggcgtgagccaccgcgcctggccaatactgccttccttttgttcccaaacagatagctgtaattttacaatcctgtgtcatagtgtaactgcccagtgggttcaccttgcctgctgcctcgacagaaccgatttatcgagagaggggaattgcaataaagaaagagtaattcacacagagctggctgtacgagagattggagttttattattacttgaatcagtttccccagacatttggggagcagaggtgtttgtttgttttttttttttttttgagacggggtcttgctctatcacccaggctggagtgcagtggcatgatctcggctcacttcaacctctgcctcctgggttcaagtaattctcttgcctcagcctcccaagtagctgggattataggtgcctgccaccatgcccggctaatttttgtatttttagtagagatggggtttcaccatgttggccaggctggtcttgaactcccgacctcaagtaatccacccacctcagcctcccaaagggctggaattacaggagtgagtcactgtgcccggcctggggagcagtttttaaggaaaacttggtgggtggggggaagccagtgagctaggagtactgattggtcagggatgaaatcatatggaatcaaacctgtcttcttgcacagagtcagttcccagttgggggccacaagatcagatgagtctctttatcaatctgggtgatgccagctgatccatcaagtgctgggtctccagcactgatcttaggagcagtttagggaaggtcagaatcttgtagcctccagctgcatgactcctaaaccataacttccaatcttgtcgctaatttgttagtcctgcaaaggcagtctagtccccaggcaagaaggaggtttcttttgggaaaaggctttgttttaaattataaactataaactaagttccttccaaagttagttcagcgtatgcccaggaaggaacaaggacagcttaagggttagaagcaagatggagtcagttaggttagatctctttcggtgtctcggtcataattttgcaaaggtgattttaatagcctcatctctaaggcaggttcccacagtgacagaaggccacatatcctcccaaatggcctccctcacaaattgctcacaagggatttccttgtgagctcttaaatctttcaggatacctgtctctcttataaactagcccttaaactaagttgtgttgaatttcaccctgacaatgtcaattaccagcttatcgtcacaagtacaggacaaggacaagaccagaaatcatccctccacctaccctgagacaaaagcgtaattgactttttcctctactccctcttttcgcatgccaaatgtagacttactgagtgctaatcagagcctcacaagcatgtaactgtttccctcgctgcctaacttccctctcttttcctccctcttgcttgctctttcctcttcaaatactgaatttctcaaaactgtctttggaaaagcacaggtcacagatgctcctgtgtcctgtgtattgcccaggcataccctcaaactttgtttaaatacacctctattgattgagacagctgtctcagtaactttttggttaatgtcttaaaagtataagacagagatgataagggcctgaaaatagtagatggattctagatggattattaagagaaaatttgcaaaactttttggcagatcatagattatgggagtagttaccatagatcaaatctataagaggtcaatttcagaaggagcagatagaagattgggacagaccaggcagttaccagagatccagtggggtataggtcaatcttttgtaggtcacagggcagagctaatgaccccaggagctaggaatgcccacatgagaactgatcctaatacagaagttgtttagctcagtcttgtctacttgttagagttgaatgaattcaactaaatcacacaaaaatgctctgaatattacaaagcactatacatgtatgaaagtcaatgggagttagtgttataactataataattatacttttcgctgggtatttgtatacctagattagtacatttgatcatatacagaagagaatctgagctcaattgaagaagtgatagaaatggtatttccccatgttttacagctgggatgtggtttgtttgtccccagaaaatctcatattgaaatgtgatccctagtgtggcagtgttgggaggtggggcctagtgggaggtatttgggtcatgggggtggatcccttatgagtggcttggtgccattttcgaggtagtgagtgaattctcattcttgtgagactggattgacttttgcggggaatgggttattataaagccagaatacctcttgggtttggtcacccctcttcacatgtgcccacttcttctttgaccttctctgccgtgttttgatgcagcagaaaagccctcaccagaagtcaagcaaatgctggcaccgcacttcctgtacagcttgcagaaccatgagctaagtaaaacctttttctttataaattacccagcctcaggtattttgctatagtaacacaaaatggattaagacaccatgactcttctggttaaactggagagactctaattaagctcctctctttctcacaaatgctcattattttgtctctgtctacgcattgtcactacttagtgttctttacctttaaaaaagttcacaataacacagatgatcctctacagtcatgttagtgcccttgcaatttccaaatctcattctgtggggtggatgctgcctctgaatgatggtgactaagcaatttgacagggtgctgtcaaaggcaaaccacaattggacagtaattaaagtggcaagaacaaattttattcaggactattgcaataggagacctcatatagaactgagctcaactttgaatacattgatcagttctaagagccttttggaggagtcttacggttttctaggtatatgatcatataattgacagcagtcacaggctgttcaaagcagccactgctgtcactccagctgcagtggggtggtgtgggtggtggcaatgggagtggctgcgggagcagcagtggtggtgatgggacctctgcgtcccatgtcccctgtgccccatgtccccgaggcagctgactacactgcccttaccctcacaaagccaggaggggcccactcccaggcccagagcctcctctgctctggaccctggccccatgtgactgctcttgctcaccaccactgtggggagggtgtggcagggaggccgacagtacctggaacccaccaccctaggggccattgtgatggtgctcggccaagctgcctgccagctgcagaacagtgtggtcggacatggaggagcggccagagcggggcccactgaggacctggagcccctccccaccacagctgcaaggaggcatggccggggctgtgtgctccttggagctggtgggaggcagggacaatcaggaaccctgctgtttctgagttggcagggtgggaactccctggtgcagctgcagctgccctgccacagctgcggatgcaggcatctatgcactcttgggagcctgggaagaccctctaccacactgcaggctcagaagtgcctgctcctgctgcctggcttctccccactgtcagtgccagctccaattcagagcaaagtcagggccaagcctgggtgctgttgcagcccagccgggtgtgcacacagccaggggcagcactgacatgccagccccctgctgcctctgccccctccaaactttgggtgctgacaagcatgggagggaggctgagggggtgctgaggacagtccagtgcttgtctgcaggtgccccttggcatgaatagcctgggtgcctgaacagcggcaggaggcagacagacttctgggtggaaggggttgggcccctggtgaagccccaccttcaatccagggaagtcctgaagcctggggactgggccgccagtcccgccgactggagggagaacttgtggtgcttttccctgggcccacccatggctgcccatggaccagtcagcatgcacatcctcctctctgaagcacacaaaaaccctggactcagccatactcaagcagaggacagaagacagagaaatgatggggagatgacaggatgaccagctgcaaagaggagctaccccctctgctgagagctgagcacttgttggggcaccctagctatggagaggaactgcttactatggagaggaactgcccactatgggtcttctctgagctattctattgctcaataaagtgtctcttcgtcttgctcaccctccacttgtctgcatatctcattcttcctggacacaggacaagaacacaggacccaggaaatggcagggctgaaagagctgtaatacaaacagggctgaaacacatcccttgctcaccacattgcgggtgacaaggaggagagaagagaggagcgaaggggagaagacctgtagccctctggggaacccagacctgggagctccctgagtcagggctgtgactcttctttggggccctgtggttcctggagtctccaagcatctgagtaccactccgttccccggtgccagctgtggaagctgcttgcaatgcgcctagtccagctgcagcctcacagtgagccagtacccatgctggcacctagagctgcctgccccgctgcagtagctgacgtgcctcactgtgtgcagtggctggaccccacgattggctccctggctcacatacccctcaccgctctgcttccgtctttttggaggtgtgggatccaggccagtagcacgagctgagcacagcctgccaggctgagtgggcccagcaggcccaagcaaaactcatgcaaaggtgccaccagctacagagctttctggccagaaaaacgatacccccaaggatcccataacattatcagcaaacagtgacagtttgacttcctctttactgatttggatgccctttatttcattcacttgtctgatcgctctggctaacacttccagtactatgttgaagaagaatgatgagagtgggcatccttatcttgttccagttctcagggaacaactttcaacttttctctgttcggtaaaatgttggccgtgggtttgtcattgatggcttttattacattgaggtatgtcccttgtatgacagttttggtgagggttttaatcataaagtgatgctggattttgtcaaatgcttttgctgtatctattgagatgatcatgtgatttttgtttttcattccatttatgtggtgtatcacatttattgacttgtgtgtgttaaaccatccctgcaaccctggtatgaaacccacttgatcactgtggagtatctttttgatatgttgttggatttctttagctagtattttgttaaggatttttgcatctatgttcatcagggatattggtctgtagttttctttttttatgtccttcaagttattttttttatttcagttattgtactttttaactctcgaatttccatttggttcttttttatgatttctatttattgatgttctgtatttgataggtcattgtcataaaactttaattatttaaacatggtttccttttaattatttgaacaaatttataatagctcctttgaaatctttgtctgctaagttgtacacatgggctccccactttttttttttaaggcatggtctcgctctgttgcctaggctgcagtgcagtggcatgattatggctcactgcagcctcaacttcctgggctcaagcaatcctcttgcctcagccttcagagtatctgagactacaggtgcacatcaccatgcccagttaattattttattttatttctgtagaggtgaggtcttgctttgttgtccagactggtctcaaactcctgggctcaaggtatccttctacctcagccttccaaagtgctaggattataggcatgagctactgcacctggtcagcacatgggccccttgaaagcaatttctgttttgtgttttcttgtttgaatgatacaagaatcattatcccatttcttcccaagactcataactttttgttgaacactagatatttcagataatatagcaactctggattcttatttattctgtactccctctgaggcttagtgatatcacagatttgtgttagcttatttgtttagtgtcttgcctagaccaattctatgaagtatatttccctctcagtgtgcagtctctgacaacactactcagtttgttttttctccttggttttattttttaaggctaattgcctaggagttgcccctgggtcagtatggcttagtgttcaatcaatgattattccaaggttgtgcttatgctgtgttatgatccgcatacgttcttccaaattcatctgttgaaacataattgccaatgtgatagtattaagaggtgaggcctttaggaggtggttaaatcatgagtgcagagccctcatgaatgggattggcaaccttataaaagggctggagggaactagtgttcattccttctgcccttccctcccttccaccatgtggggacatgaagtcaccccttctggaggatgcagcaacaaggcaccatcttggaagcaaagaacagtccctgccagacaccaaatctgctggtgccttgaccttgggcttcccagccaccagaattgcaagacataaaatttctgttctttatgaatcacctattctcaggcattttgtttagctttgtttcgtcttgttttgagacagagtctcgctctattgcccaggctggagtgcagtggcaccatcttggctcactgcaacctctgcctccaaggttcaagccattctccagcctcagcctcctgagtacctgagattacaggcatgtgccaccacacttagctaatttttgtatttttagtagagacagggtttcgtcacgttgttcaggctggtcttgaactcctggcctcaagtgatgcacctgcctcagcctcccaaagtgctgggattataggtatgagctactgcgcccggcccaagcattttgttatagcagcacaagtggactaagatatgctccttgagccaataagggttcaagacttagctgttggatctgagtagctttggggatgctttcaattctgccgcatgttctagtagggaccagtagctttcaaatgcctgcttcagttgctcatagactggaggacttatcccttaggatcagggaggctgtgtgtatatgccaggatgcacctactagtaagtgcagcctggcataaatacacagcctccctgatcctaagggataaacatgattttaacagggtactttttcgccgtcctttccactggttccctttgtgagaattctggctgatttgctgttttgtctgttggtattggtttcatggaaatattagtcttctcttaattgcctgacatgaaagttgttcttgtttttcactacaccttaaggcatgggttcctccatactctgttccaaataaaaccagcccctcactagagctgtggagctatgagccctccagtcttgcccctccccttgggcagaacctctgtgcattgcactagagatacagctggggcagggatggtggcttacatctcccaaaatgatgcctctactctgcaaattggagctgaaagggactgtagctcctgtcttgtctgattgcccttccctatatggaacctctttcctatgagtgggatctggagtgggtattgctactgggtccacagcattgccttgcctggggtacaacctctactctgtgaatgggagctgggtgaggggaagggagccctcatcttctttgtagtggaatagaccttgtgtaacacagagctggtggtgggggtagggggatgagagatgcttgtgacctttccctccacaggtgaaactgtagtgccaaaactgggatctgtgggtgaagggagccctcatgttcttggccacactctcctgaggttatagcttctgtaacatggagttgggagggttgagggggaggggtgaaagcaggttctagttcaagtgccatagacttgtgctgttcttaccaagatgtattaggttttcttaaataaatgccttttgatttgctgtatgaccttagattgacctccaaaaactttaaatggctgtgtttaatacttttcaccagttaaatgactggtttactgtagagaggtccaccaagctcctcacactgttttagaagtcccattctgtctcactattcttgctgataattaccatgatccatcaaaatgacttaacagacaaaatgcagcaaatgtaatgttcagaaagcccattttctacaattgtgtccatgcctcagctgtgcctgccaatgcaggtctgtgttccattggtgacccatgttctctttcatccttggatgcttgaaagccttagtttaagaccagaacaacctaagaggagttgtcctgaaactgcctatatgtgcactcttgcctctacagcaacagccccttgcttgctcatggataaaactgtcataagctatagtcactggtcgaggacaaagcaccatggccaccttaaagcctttcacataggacagagctgaatattctcctccagctttcaaggctagaaggctttagctactcactgatggtccagcccaaagcctataggttccggcttcaacaagagtctcagtctgctatagtttgaatgcttttgtaccctccaaaactcatatgttggaaacttttttttttttttttgtgagatggagtcttgctctgtcaccagactggagtgcagtggtgcaatcttggctcactgcaaactccgcctcccaggttcaaatgattctcctgcctcagcctcccgagtagctgggactacaggcatgtgccaccacacccagctgatttttgtatttttagtagagaaggggtttcaccatgttggctaggatggtcttgatctcttgacctcgtgatctgcccacctctgcctcccaaagtgctgggataacaggcatgagcttctgtgcccgggcatgtgttggaaacttaatcctcactacaacagtattgagatgtgagacctaactggcagtgtttaggtcatgagggcaccatcctcatgaatggattaatgctgctatgaaaacaggagcttgcaggagctggttttctctctcttgctcttctgccatgtgagaaacagcaattctcccccccggaggatgcagcattaaacatgccatctcagaatcagagaggccaggccctcaccagacaccagatgccagcacctttatcttagacttcttagcctctagaactatgagaaaataaaattttgttctttataaattatccagtctcagatattttgctatagcagcacaaaatggactaagtcacagttactttatgaatttttacttccccaaattctggtgttttaaatttttatattaatgttcccagatgatatacaaaaactattgagatcctaagctactttcatcgaaatacagctcttccccacctcaattgctctgtgatttttaaggcacgcaaaccctgtcagagagggtttccctctgtcttcttttaggtatattcccattagtgttattgatatcatttgcttgatcctgaggccacagtgtttatcatccctgcaatgaaacaaacagatctcaggaaggatgctgaaaagattatgcatttatatgggttataaaaagcctgtgagcatttctattcacaggggtctctcctagtaaattctgcagttaaagatgcttctgactgtatgaattacatttaaaaaattgctggccgggcatggtgtctcatgcctgtaattccagcactttgagaggctgaggcaggaggatcacttgagtccaggagtttgagaccagcttgggtaacatggtaaaggccggtcactactaaaaatacaaaaaattagctggatgtggtggcacatgcctgtagtcccagctacttgggaggctgaggtgggggaatcacctgagcctgggaactcaaggctgcagtgagctgtgattgtaccagtacactccagcttgggctgggcgacaggagtgagaccctgtctcaaaaaacaaaaaataaataaaaaaataaaaatttgctggtgattagatgggaaataaaagattcattagaaatttctaatattgtccattgactcttgctaagaaatatttgtcacaaggcagttttgtaattgataaagttaaaacgattttcagaggtagttttaggcctttatttctttgttgacttttctaaacagtggtgctgtgattatgttttcacttatttcttccccacaggtgagggtcacaacctcttgtgcccagagcatgctgccagcacacattactactgcttccccttattctgatggaaatgattccttctttgcctgcaatgttggtattgactattttcataacttctgtgttgattacttttatgtgtcacctagactgggctaaggggttctcagatagctggtaaaacattatttctgggtgccatggtttaaatgtgtcctctccaaaattcaggtgctacccatgtgatggtattaacaggtgactaggtcatgagggttcctccctcatgaatggggttaaggtcctcataaaagagcttcatgcagtgttcagctacttgccctcccccccttccaccatgtgaggacacagcgtccctcccctccagaggatgcaactctcactagacaaccaaacctaccagcaccttgatcttggatttctcaaacttcagaactgtgagccaataaatttctgtcctttctaaatgatccagtctgtggtattatgttatagcagcaaaaacagactaagacactgggtgtgtctgtgaaggtgtttctggaagagatttacatttgaattgcagactgagtaaagaaaaatgccctccccactgtgggcaggcatcatccaatctattaatggcctgaataaaacaaaaaggtagaggaagagagaatttactctctgcttgaactgggacatccattttctcctgtcctcctgcttctcaggcctttgggtttagattgaattacaccaccgactttcttgagcctccaccttgaagatggcagatcatgggacttcttagcttccataattgcatgagccaatttctcacaataaatctctgtctatatatttatatatatatctgattgattctgtttctctgcagaatgctgactaatacagcttctcattggaggtaagggggaaatggtaactgaagttcttgattgaaatcctccagattgaagccttatacttctacccaaacagccggcaggcatagaagtattccctaggctgaacatcttagtggtcaccatagttttgggaaggcctgaggcagggtttgtcgattctgcattcagaacagtaaggcttcttagaggcaactcgagtttatattagaacactaaatatagatgttcaaccacatagcagaagagaacactgccatgaaataatcagcattttatagcagtatttattattgtacagattcagtattgcttgttcacaaagtcattcttaaccacctacaatctggtaagactgccaggcatacaagagaagcagagacagaagtgtttaaaatctgaagtagagaaaaaatggatacatataaaacacattatgatgaaagactatgtataattattaaattatgaagcttccttcaaatgcaacaatactgtgtaataaatgatttctcatgtaccaaagttgctagaggaagtgatagttcagagtagctcatggattcccagaagctcatctaagagttctttgcctgcctgggagtccatacaccccagattaagaaactttaaattagctagtgtctaggaccctttgtagctccaaaatacttggagcttgggctcctaggcttagtatcaacttcagctccttcctatttttgcaagcatgttctccacttgcctgcctcatggatctccttcttttgtcaggaagacaacccagtgtgttcagtttcacccctcccttgctcataccatatttcatctgttcagtggctcagaaaatacctgtggtgcaaccacgaagcatgggctccatgacacagcagggaggctcccagacaaagccccgctcctgtggattgacactccatctcctaacagaaatggcttttcctttacttcttggcttctcagctagctgagtcaacctagctgaccattttccctgcttctaaaattctgcatttcctcagatgacgactgaatgttcagccttcattacgagatgtttctgcagtgagtgagcttacctgggctcagtcatcgcttctctacagcttgatgcctgtccttcagtgaagggatcctgtcacgtttctttttttttttttttttttttttttttgagacagagtctcgccctatcatccggcctggagtgcagtggcgtgatctcagctcactgtaacctctgcctcctgggttcaagagattcccctgcctcagcctcctgtgtagctgggactacaggtgtgtgccactacgcccagctaatttttgttgttttagtagagacgaggttttgtcatgttggcaaagctggtctcaaacttctggcttcaagcaatgcacccacctcggcctcccaaagtgctgagattacaggtatgagccaccctgcccagccctgtcacgtttctttaccatctctaggcacctgttagattttggttttgaaattctgtttgactgattatcatatgtgttattctgccctaaaacagtgactccagacagaaccttaagaaaatactttgcatttgtatggctctttaatcatttgtgttaagatattattctgagacattctcactatagccctaggatttgatgagctaactaggtatggacattatttcccattttacataagggagggttgatcccacatgaggtaatttcaaggatttgttctgagtcacagatcacagaaatcacaaagtaagaatggatctgagatttactgggtcctaggcctagtgtctagttccttcaacaggactctaggattaggaaacaccctcccatcaaaagcaatcagcatctcaggttagaacagagtttggagtgctgggaattctatcacttcggatggagcgagagacattcagacattgttgactggactctacaggtgacttgcagacttccatttaatttcagtatcctcctcaaaatcagtggctagctgcacaaatagggattctctttaatcctcaatttataattgctgacagacattctggctccactgccaagctgtgtggattcccacttttggggccaactttctttgtgacttcgaggaagtcaccaaattgactttttagacctagactttcctatgtgtaaaatggaggataattccactctccctacttatgctttaataaatcatagcttctaatatagatgtgctggaataatacacattaacctaaaaggtgaaaagatctcactatatccccagctctgacaaggtcattccaccaaggtgtggagtgacttttttgctctgtagtcttatggaggacttctgtctcatctgtaaatttggtgcatatcatttatagccttatgctgatcacagccttgtttctctttccttattggattataataatatatttgtatagtccattgttttcaaagtagcgtcttccacattgtttcacagaattactaaaataacttgtgacttaggcaggtcaggtgtccaaatttccatttttctccctagcttcttcaccccttcagtaccagccccctcatggagcctcactttaccacctccttcaggaagtctgccctgattggagcctgagagagcaaacactctgcacaaaggaaaggcctgagaaacacttgaataaatacatgaatttgtgagcccccagtagcatcacgacatagcctgagaaacacttgaataaatacattaatttgtgagcccccagtagcatcactctaacttggcaatgaaaaataaaggttctgaccttttttgtttttctgctttacctgagtgcaaacactaaaatttagaaatgcgagcagagctgacatttggggaatgggcaccataaaaactcttaccatgttgtaacctcattattatatcagcatcatttttttatgcaaaagggaaataatgcacaactgaaaagatttttatttctatttaaagcatagatgtttttaagcagcactcactacattttttaaatgtgttgagaggatggaaagtttggagagctggaggctatttttcagctttgatatggatggactatgtggtactctctgagattttctatgttttttttcccccaggaggttaaaatgatacctttttgtataatgtgaaaggtgtgtttgagggaacttggggagcaaaggtaattattccgatgattcatccaaaacccattctgtcatgaaggaggaaaacaaagtgtagagttggacctgagctgtccagattgccagttgacataactcacattcacagaatgcattattcctttgcttgttttgctagagcacctttcaggtgtgcctattagtctgttaagactgataagtaaatcagtgtcttataaccaaagaatagcagagatctgagaagctctgactccctggagttgctgggtttataaagcatttccaccttccaaaggcatgccctaaactagcactcaagaggaagggagaagaaaaggagcacttgtgtgctgaacattgtgttgggtgttttacaggacttcttccctcttttaattctcacaacaccactctgagatcagaatttacagatgacaagactaaagctttaatagattaaggtgcccacaaagagtgggccaacctgagatgagaacctcagaaactgcaaattcctgatgtccttgagccatcgactacaattccacctgcttctggagcattctaggtgtgattcaagttagtgcattattagtcagattcattattgagcacccacaatgtgcaggcataataccaggagctgaagacactaagatgaataaggcaagacctcacctgttgaggaatcgagtatggtaccaggggagcctgaaacacatcttcatgacagtagtattgctgtgggactgcaaaggaggagctgatcagcagtttcctggaaaagttcttaagggccacagtaggagagagaaatctgaaatcctggggtcacctgaacaagagtctcttctcttctgcactagatcacatggttatatggagaacctcaccagaaagaccctggcatttgatcacaggaagactgggcccaaatcctagctgtagtatttataatgtgtgctgcatggcacaagttacttaacctctctgagtcttggggcttgcctttgtaaaaatattaggataaaaatgccagctttatggaattgttgtgaagcagaaatctcaagatgctttttgtatcttagtccttgtctgtcttctttctagtctacaatattgcttcttgctgtgcactaaccattgtgagattctctgtataaccacgtagcctagtgcagaagagactctgatccaggtgaccctagagttttagatgaaaatgtgccaatttgcatctaaggtcctccagacagagcaccctctgaggacataatctatgggaaagcaggccaataatactcactacttcaggtgaaaagagaccaggcccaggaggcacacaggctgggcactataaaataaactggagaaagatcagcaccaggtttttgccaggatactcaggtgtaacacctcagtgacttggtggaaaacaaattgggaataacacttgccgatgataatatttgggtgccaataaagaggggcagatgattaatattaacatgctggggctgagaagacagacataatatctaacctccccaggaggaaggctggccttggaatgggttacattccccgaaagccccaggctgctaatgagatagattacccagctgcagctaatgagaaaggggctaatgagtctgcagatcactggccagccttagccataggtcaccaagcagggagactactgcccttttttatagaatcattcatttgaagtaataggtgtgatgtggcgtttgcttcttggctccttaatagtgacactgtttctttatcctggtcaggttgccacagggaagttctgtgattaactgattggaatgagatgcctcctgggaaggccacagatgatttgtgggtgggagagggagacatggacagaatggggcccattgagaatacagacattctctaggctctgcagtgtgaaccctgggtgaagggtacatcctagattcccagatttagacagatagtgggagcagaagtgtatgaatatctgaatttttgccatgcaaacaacagtccggctttataagtgaccttgaccacaatcatggttttgtttgggggtccccaataccaccttcaggttcaattatttgctagaagcactcacagagctaagcaaagctattgtactcatggttattgtttattacagtgaaaggatacagattaaaatcagcaatggaaaaaagtgcatagggaagagcccaggagagaccaggtaccagtttcctgttgtggtctcccaatgaaattttatgaacagcacttaattctcccagcaatgatgtgtgaatatatatggagtattgttaactggtgaaactcacttgagccttggtgtccaaggtttttactgggggttggtcatataggcatggaatattcatgtgactgatcttaccttaatcttcagcccccagagttcaaactgatacacaagcgatcctccgacctcagcccccaaagtggctgagagtacaggcacgcaccaccatgcccagctaatgagtcacatggcccaaggcaataagtcacactgttagcataaactatctcacctgacctctcagatgaacaaagacactctcaacaggcaggatattccaagggtttagaagtcccaggagcctgggtcaaaggatcaaatatttctcgggagcttacagagtttgcacaactcagaccttctgagttaattctttactgcatgatggaagaaacagaagagtggtagtccctctcctttctagagaacaggattggtttggcgtgtggcttgaaattttaaaacatgtgtatgccacttttctattggactgaaatctcattggcatgccatatttgacagggtctaaaagtagtgttgtgaagaggcaaatgcattggagtaggaaggagaaatgtgagtcaccttggagctctatctctcctgactgtagaaccacagacaagtctctcagcctctttggttccagttttatcccatcatacactactggcaacatttaatctacttcctgtgagcaacatctacccttttggggagtatcaaattaaataataaatatgaaatcaacttgaaatttgatcacaatacacaaatgagatattaaaatagcagtttgctattcaatagcttttacgggaagaaataccacacgattcctgactgagaatattggttgggggcagtggtaatttttaatttgtctttttaggtgcagtgttatcactattcttgaaatattgatttgaaaacctcaaagaagattaaaaatgctgttaaaatccctaaaggttggagacagagggcctattaatgctacccatcatattcattggttatatgacaagcccccttatctagcgggcacctgcatctgcactggttcaaacagttctcttttgaaattgttatagcaagttggtcagcattattcttccacctgagagatctggaaggggctgctgcataaggccatgcctgttgtgaactgcactattcatataggctatgacatgaatcacactccttagagctgtgcaatgtggaaaccctcattctgggaaagatcaaaaagaatagatgtaggattttataatgtttaaccaagccttgctaaaatcagatttttgtagttaaggtcatttttggattcccctatgtccaacaagtgtgaaaagcagttgactacaaatcatttgcttgctttatttatttatttatttatttatttatttatttatttattttgagacagggtctcactttgtcatccaggctggagtgcagtggtgcgatctcagctccctgcagcatcaacctcctggtctcaagtgatcctctgacctcagccccacaagtagctgggagtacaggcacttgccaccatgcccagctaatttttgcatttttattagagacagggtttcaccatgttgcccagcctggtctggaactcctgcgctcaaacgatccaccccccttggcctcccaaagtgctgggattacaggtgtgagccaccacgcctggcccaagtcatttgctttcgaaaaaagttactgatcatcttcctgtggaattattttctgtatcagtaatagtctctttgacaaagatgggtggaaagactgtgacgcttgatgtttagaacttcaaacacaatggcctcaaatgaaagatatgcttaagtaggtggctgttaggcctcaaattgtactgtcatgactggtcacctatttatccttccagaatttttcttctgcagggttgacctagagtgagaaaaggacaatgctttctgttttcgaatgtgaatatgccttagagtatgtgggaatgtttcattttcataatccccttaactcctcattgccacctagctgatgatgacattgaaaatattatgctaccaaattgaaggctgacactcattatgtcattaagtaagctgcacttatttaactgattaggcaaaatacaaatgtgtaaaaatgctttaattttttttccttgtttatacctgctagtaaagattcttaaggctttacttcagtggaaagcattccataagctgggctcttccttcatcctaaatacctactatgtcaaaagaccttttcactccaaagttaggaagagctggccactatctgatcattttaatcttgtctatacaatcttcatttttagataattgccattgcttttatctgtgcttcatacatagttcttgccatgttttactttagctagattaaaggtaaagagaccaacaaaaatggcaacttttatttttctccttcgagaatgcatcaatatattccacaaaatggaaaccaacaatgagcaagagtagctatatttatatcagataaaatagactaagtcaaaactgtaaagagagacaaataaggtcactaaataataaaaacaggatcaatttagctagagaatgtaacaattgtaaatatatatgcacccaacgctggagcacccagacatataaggcaaatattgggataaaacccaatacagtgatggttgtggactttaacacctcaatctcagcagtggctgaatcatctagacagaaaatcacaaagaaagatcagatttaaattgcactaccgatcaaatggaattaacaggcatttatagaacatttcataaaacaatgacagaatacacattcttcttttttctttttctttttgtctttttttagtcagagtcttgttctgtctccaaggctggagtgcaatggcatgatctcggctaactgcaacctccacctcctggttcaagcaattctcgtgcctcagcctcctgagtagctgggattacaggcacatgccaccacgtctggctaatttttgtatttttagtagagacagggttttgccatgttggccaggctggtctcaaactcctgacctcaagtgatccacccgcctcagcctcccaaaatgttgggattacaggcgtgtgccaccacaaccagcccacattcttctcatcagcacttggaacattctccatgatagaccatatgtgaggccacaaaacaagcttcaacatgttaaaaaatcgaaatcatatcaagtatttttttctgactacgatgtaataaaactataaatcaatcacaagaagaactttggaaactgtataaacgtaaggaaattaaataacatgtttatgaatgaccaatgggtcatggaagaaatttaaaagaaaatttaaaaaatgtattgaaacaaatgaaaatagaaacacaatataccaaaacctataggatatagctaaaatagcactaagggaaatttatagcaataaaccccaacatcaaaaaaagtagaaggttagaaggaacaagattacataaaaaaagaaaagaaagcagaaaaatttcaaataaacaacctaactatgtgccttaaggaattagaaaagcaagaacaaacaaaacccaaatttgtaaaaagaaacaaagaaagatcagagcagaaataaatgaaatagagactaaaaaaatacaaaacatcaacaaatgaaaagttggtcttttgaaaagataaactaaattgacaaaccattagctagactaacaaaggaaaaagaaagaggatccaaataaataaaatcagaaacaaaaaaggagacattacaactgctaccacagaaatacaaaggatcattagagactattatgaacaactctatgccaacaaattggaaaacgtagaggaaatggataaattcctggacacgttcaacctaccaagattaaaccaggaagaaatagaaaatctgaacagaccaataacaaatagtgaaattgagtcggtaataaaaagtttccaaacaaagaaagctgcaggactagatggcttcacctctgaattctaccaaactttcaaagaagaattaacaccaattcttcacaaactattccaaaaaattgaagagtagggaattcttccaaacttattcagaggctagcattaccctgataccaaaaccagacaaggacacaacaacaacaaaataaaactataggacaatatccctgatgaacatatatgcaaaaatccttaacagaatcttagcaaactgaatccaatagcacatcaaaaagattatatatcatgatcatgtgggatttattccagggatgccaggatggtttaacatgtgcaactctataaacatgaacagaataaaggacaaaaaccatattatctcaatacatgcaggaaaagcatctgataagattcaacatccattcaagataaaaattctcaacaaattaggtacagaaggaatgtacctaaacattcaataaattaagtacagaaggaatgtacctaaacacaataccccacagccaacattatactgaatgtggaaaagttgaaagttttctctctgagaactggtacaggacaagaacgcccacttttaccactcttattcagcatagcactttaggaagccctagccagaacaattacgcaaaagaaagaaataaaaaggcaaccaaagtgtaaaggaggaaataaaattgtccctgttagcagacagcatgatcttatatattgaaaaactaaagattccaccaaaagactcttagaactgatgaatgaattcagtaaagttgcaggattaaaaaaccaacatacaaaaatcagtagcatttctgtacaccaataacaaactagctgaaagagaaatcaagaaagcaattccatttacaatagatacaaaaaaaaaaaaaaccgcctaggaataactttaaccaaggaggtgaaagatctctacaatgtaaactgtaaaacactgacaaaaaaaaaaaaaaaaaaaaaaaaaaggaatccagcaccactggacatgaggaacaaaaataaataaataaataaataaataaataaaataaaccgaagaagacacacacaaaaaaggaaagacattctatgttcatagattggaagaataaatattgttaaaatgactatactactcaacgccatctacagattcaatgaaatctctactaaaataccaatgacattcttcagagaaatagaaaaagcaatcctaaaatttatatggaaccacaaagacctgagatagctaaagcgagcttggtcaaaaagtacaaaactggaggcatcacaccacctgacttcaaaatatactacaagccatagtaaccaaaacagcatggtattggcataaaaatggacacacagacccatggaacagagtagggaacctagaaaatccatacatctacagtgaattcatttttgacaaaggtgccaagaacatacattggggaaagaacagtctctttgataaatggtgctgggaaaagtggatatccatgtgcaaaagaatgaaactagaccccaatttctcaccatacacaaaataaattagagaattaaatacgagatctgaaactcaaaattactagaaaaaatagaggaaatgtttcaggatattagtttggacaaagattttatggttaagacctcaaaagcacaggcaacaaaagcaaaaatagacaaatgggattatatcaaaccaaaaagcttctgcacagcaaaggaaaccatgaacagagttaagagacaacttgaaaaatggaagaaaatatttgcaacctatttatctgataagggatcaatatccagaatatacaaggaactcaaataacagcaaaacccaaataatccaattaaaaaatggacaaaagatctgaatagacatttctcaaaagaagatgaacaaatagccaacacatgtgaaaaaaagctcaaccccactattcatcagggaaatgcaaattaaaatcacaatgaaatatcactttaccacagttagaatggctattacaaaaaagagaaaaaaataaaaataaaaaatactggcgaggatgtggagaaaagggaaccctcatacactgtgggtgggaatgtaaattagtacagtctctatggagaacagcttggaggttcctcaaaaagctaaaaatagacctaccatatgatctagcaatcccactactgggtatatatccataggaagtgaaataagcatgttgaagagatatctgcacttccatgttcattgtagcactattcacaatagctaagatatggaatcaacttaagtgtccatcagtggatgaatggataaagaaaatgtggtatacatattcaatagaatactattcagccataaaaataatgaaatcctgtcatatgcagcaacatggattaacctggaggacatcatgttaagtaaaataagtctggcacagaaagataaataccacatgttctcactcacatgtgggagctaaaaaagttagctcataggagttgaattgagagattgagaacagaagtagaagtagagagtagaattgtgagtattagaggctgggaagggtaagggtaaggggaggttggggagaggctgtttaatggatacaaagttatagctagataggagaaataagttctagtgttctatagccttgtagggtgcctactgtaaaatactgtatttttccttatagctagaagagacaatttttgtttgtttgttttttgcttgttctttgttttttttgagatgaagtctcactctgtcgcccaggctggagtgcagtggtgccatctcggctcactgcaacctccgcctcccaagttcaagtgattctcctgcctcagcctcctgagtagctgggactatgggcatatgccaccattcccggttagtttttgtattttttagtagagacggggtttcactatattggccaggctggtctcgaactcctgacctcgtgatccacccacctcggcctcccaaagtgctgggattacaggtgtgagccaccacgcccggcaaagagatgattttgaatgttaccacaagaagaaataacaaaagtttgggtgatgaatatgctattaccctgatttgatcattatacattgtatacatgtatcaaaatttcacattgtactgcacaaatatgtacaattattacgtgtcaattaaaaatatatattaaaaaattagaaaaaaatttctgtctctaagcctgtggttgtagttgtggtaaaaattcacaagcacaaatatgctggacaagaaaacatagcctaaaatgaaaaaaataaggttgtcagaaaggaatttttttaaaataaaaatctgcttatatgctgtttaataaaaaggatgcattgttaagagaataacattttcccacataattagcctaagaggcaatgggtttgtttgtgttacttgaagaactagcaagaccttcagaacacctcagtcattcagtttagtaaataagtttggtcacctaatattttgtttattttgtatatagtatttcaattttttaaaatcattgctaattcctggatatctgttctcctcctcatgcttttgctgttgtatttgcagttaccccctcccctattgctggatcttctcttcttgctgttctattcaccttgcgaatttctaatggcccagagcttctaatgcaggttaaggagcgcgacacagggaaccactgagggtcaggatcagaccaacgaacatacaaatttctttagagggggcatgtggacagctatgctgaactcccagtcatctgcctccacagaacctctttacacacacaaagacaggcaattgcagtatctaaatgaccatataaattgccatttctttccttttcttaaagacacatcctgagacacttatgaaatcaaagtggaacatatggtttttttccctttaaaagcactgcttgtcctctgtccctctctgccaactctcttacattcccaacaacattatctaacagtctttaaaggacaaatgctcacctcccctctccactcagggaacaggaagagccagagaaaaacaactgatggagaagatgccctaaggttgaatatttcttcccttgggggagctgaacgtccagagaaaacaaattaaattatcctccttatccttgggctgtgacatcaaagtggacattatgtaccaatacccccttgctttgtttcataacctcaaatcaaaattaatctgttgtcacatttgtttatggtgactaacaaaaagcctgaattattcaagaaaagcagtttgggacacaagaacaggaagaacgacctagcaaccacagatcattcttttcctgctttcaaaggagtaacatttcccatcctctatttctggaagccctagtaaggccttccactctgctgtctgaagtcaagtttgagtgcctagagagaagagaatccttgtgttgcaggtcagttaatctggagcaggtcctgcacagtccctcctatgcatttatttagccagggagcagttattaagcactgattttgagtccagaccttaccatacattttttttcattcatacagttattgggaacttgacttttgaattgctgggaagtcatttatgaaaaggtcacagtcactgcttttgaatagctttagtcctgtcatggaggaaacaaatcaacagccatatatgtgacacagtttggtgagcactataagggacctgcatagggtgccataggagtatacagaaggagtctcaagggcagccataggcaatcaaggaggaggagaaggtggcatctaaactgaaactgggggaactgcatacaacaggtaggagttagcctggtgaagctggtgggcaatgtccttcctggcaggacagcagagcaaaagttgggaactgtattatgagtgtagagagcattgggaggtgtcttagtcaccttgggctgttataacaaaatatcatagcgtgggtggcttttaaacaacataatttttttcttacagctctggagactggaaatctgaaatcagggtgtcagcatggttttgctgaggacctttttccgattgcagactgctgacttctttttgcatccttacatggtggaaagggcatgagagagctctctggggtcccttttataaggacattaatcccatccatgagggcaccattctcatcacctaatcccctcccaaaggccttacctcctaataccatcacatgcgggtttaggatttcaacataggaacttgaggggatgcaagcatgcagtccattgcaggaggcaatgtgaaaccattgaagagttgtagggaagagcacaacctgatcagatttgcattttagaaagctgtctctagctacaaaaagttgactatgaaaaggcaagcctggaggcagagcaaggtagttagtggtcttcatgcttcttataaaggacggtggtggctggctggaaggtaatagagttgatgaggtagagaaattaatgccttcaaaacatatttagaaggaggagaaacaagatcggctggctgattagatgaggaggggcagatgtgggaaagacagaggccaaatacagagcctctgcctttcaggagcttagagaatgcttgagagagcataacctgtaaatgtaaaccatgtacatttcaggcagttcagtgtagtggtaagaatttgggctttgaaatcagtcaaacttgctttgaattcctgtcatatcaccgattagccacatgatatagaaagattactcgaatgcactgcatctcaggttccttattccttacaggtgggttatgtgtgttcacatgtgaaaagtatgtggcacccaagagatgttctaaaaatattagtaaatctttctatggaatgataatcatcatcataatatacttattactgtaacactaggaaaatagtagtcattattatataaaaccatgaaaaacattttttgggggatcaaatgtacattaaaaagttatttttttttctcttacaagtttccgagtatcagaaaactccctctattgtgcagttaggaaactaaatagaaatatgtatcatttttctgaatatctgtgggtaatagattccatacctccttggatcaacagtttatacctgttgacgaaaagagtcaaactctttaaaatattgtaagagatttattctgagccaaatatgagtgaccatggcccgtgacacagccctcagaaggtcttgagaacatgtgcccaaggtggtcagggtacagcttggttttatgtattttagggaggcatgagacatcaatcaaatacatttaagaaatacattggtttcattcagaaaggcaggacaactcaaaatggggaaggcttccaggctatacgtaaatgtaaacattttctggttgacaattagctgagtttatctgaagacccaggatcaaaggaaatgttcagggtaaggtaaaggattgtggagaccaagttttattgtgcagaggaagctctcagatagtagacttcagagagagcaagttgtaaagtgtttcttatcggacttaaaagggtgcttggctcttagttgattatctcctggatctggaaaggaaggaaggaaaacaaagggggaaagggattctctatagaaggcggatttttcctacaagagactttgcagggcaattccaaggtatggcaaggaaatatattttggggtaaaacattttgactttttcccttgttatgtcagaatcagattgaaaagtaagccatgatatacatggttaaataaaacccatctgatgagagaatttatggtttgtagggcatgactccccagaccccttagaaaggaatttgggcaagattaaaacaaaaacaaaaacaaaaacagagcttagtcctcattcctataacggtctggaagttcttccatgtatctcaccacaatccctcttgctttgttttagcctgtttgcttttgctccattcccttagatttcttcttgctgttctaagtgtagttactttcttgtcagggaatggtttatcaaattatcttgcacgtttttgcgctgggactttatatttctctgatttcctggttctgtctaaagaatatattaacttatttcttagaattggcatggttttctctatacaccgtgctcattacttttctatttagagaaaatatttattcatttaatttctttttcagaagattcccttctggttttattttgatggcctaatttcaatttgtctcctggatcaaagtatgtgacttgtgtttgtttccatgtaaaacattgcccaagccagcatcaaggagttccagggaagccattccagatcctcgataggtgggaatgtttattctcgctctgtgttacagataggaacctgagacaaatagaggtgcctgattgatccagaatcacctagctgtcagatacccacacagaattgatcagacagaggaagctggctgctccaggcatactgcaatggatggaatgtttgtgtctctccagaatttatatgttgaaaccctaatccccaatgtgatggtattaggaggtggggcctttgggaagtaattaggtcatgacaatggagccctcatgatgggataagtgcccgtttaaaaaattgatacgaaaatacagttagatagtaggaataagatctactgatctggtagcacaatagggcaactatagttaacagtaatttatcgtatacttcaaaataattatagaagtggatttggaatgttctcaacacaaataaatgataaatgtttaaggtgatgaatatcccaattacactgatttgatcattacacattatatacttgtaacacatgtattccataaatatgtacaactattatgtacccataaaaattttaaaatagcatattctcaaaaagaaaaagaacagacacgagagaactggcttcctctctgcaccatatgaggataaaagaagatgaccatctgcaaaccaggaagagagccctcaccagtaaccaagtaagttggcacttagatcttggtcttccagaactgataaataaatgtttgttatttaagccacccagtctctgaaaatttgttactgctgctggagctaagatagtggactgcacaattttctatctttagatgccttcaacctctttctcaggggggtctgctagcagcccttgctgtcttctatgttttcttcttctgatcaaatctgcctctgaaaaggacctggtctacttttggtatgtatttcagagaaggtactactcctctctgggttacatccttacgtgtatttataaaatggaaggggctgttccctgtgaaggaaaaacaggcactaacaagctggtaaggcagcttagtcgggggaatggtctgggccctcccaagagctctccaaatgctgccatgttgtagccatatattctgactctgtccctacaatctcatacacacagtgcatgaggctgtgtagtcagatagacacagtctccacacctgggcctgcccagagattgctgggagaccttgggtgggttactctgggccacagtaacctcatctgcagtctggtgacagcaatccttattttacaggattggaagagaacaagtgtggagtttccaggctagcatagtgtccagattgcagggtcttataaatgcctttcctccctgcttctaagtcaaaacctgtgagcacgccatgttttcactgaagtttctatttgtagttctagttcctggggtatgaagaaaagaaaaggaaaatgatttggggatggctgcaatttgtaacaagtcagtgtgccacaagacatcttggatatgctgcctgtagtgggttgaattgtgtccccccaaaatatatgtccaagttctggcccccagtacctatgaatgtcactttatgtggacacagggtctttgcagaggtaactaagttaagatgaggttattctggattgagagtgggccgtaaatctaatgattggtgtctgtatgagagaaaggagagggaagattgagacacagagacacagtagagaaggctgtgtgaagatagaggcagagactggagttaggttaccagaaaccgaggaatgtctggggccaccataagctgaatggggcaaggagggattctctcctagagatttcagagggagcatggccctgctgacaccttgattttggacgtctggcccccagagctatgagaaaataaattttggttgttttaatctatcaagtttgtggtaatttgttacggtagccacaggaaactagtacgctgcttaaaaggaggacatttattcaggcatcaacatgtccagagaaaacggcatgcgtatttgctagtattttcccatctggtgtgtccagagcatcaggagaggcaggaaccctcccagcagccatctggtctctctacctggctccaggcagagctggcacctgtacatagatggtcccatcccatgcccaggttgcatgtgatagaatttctgactgtgatgtgttacatgcgggcatctgtgtgcctcctcatatgcaggtagaataaacacactgccctttaaatgttctccaagcaaggtctggcccaaagcacaatggcaggtgtggtcattgtatttccgcaggtgcatgaattaccacttaacacagtgttaagaaatagctgattttcttctttgactaaaagatttcttgaaattgctttgataaaataagatcaacactaattccctttttatgcattgtgcctatcaattgaaatggaaaaaagaaagccactgccaactttcatttatttaaatgcatggatagatacatgcagatatttatgatttctccctaggattcacagatgcaaatggaaaggaaaagtcgcaatgctaagtgtacgtattttgtggggaagacaaataagaacaaagcgctgcttgctcagatggacagctctgtgtctccgcctacagggctctgggtgtctgtgcaccagggggaacctgaagtggccgcctcttcacaacctctattccatagacagttgcttaccccaccccttgtcactggcataaaatcacttgaaatatctaacacctaaaattgctaaaatgcacagtggacctatgtaacagcgatttatgcctatgagggcctgcatccaaaatgaacaaggagagagctgggctgctgtcagtgttattgtggctcattgtctatgcacaaactgcagtgctacagaagcaggtagcatttatggccttctgtttgtttgctgtcactttggtacctcagctctgaggtttcctttgaggaagagggagtggaatgtatggaagttttgacagagaatttaacctcctcttcttagagagtttaaggggctactctctagaatgatcccgtctgacatttagataacactggattctgttcatctcttgcagaggaacttaccagcagggcctctgtccaaatgcaggaaacatgaacagaatccccagcttgctttctcccacaggactctgagaaataatcatcctgtacatgctcccatttgacgccttttaatggaacaaattcaccattggaaatatgcaggaagttgatttcttttatattttgccatctttaaccaatccctggataggttttcaaaatctcattgaagagaaatatttggatgagattggggaagtggaactcaggtttctcttggtatttataattgggtagaatcaaggaaacctaaatggccataatgttttacctttaccctttgctatggtttgaatgtgtccccctcaaaattcatgtgttggaaacttaattcccaatgcaggagtgttgggagttgggacctgataagaggtgattggctctgctctcatgactagattaatgtcattatcatggaagcaggtcagttattatgacagtgggttgttataaagtgagttcagcccctggtgcctccctctgccttgagcactggtttcacctctgccttctgctgtgggataacaaagcatgaaggccttcaccagatgctagcaccagcctcttggacttcccagcctctggaaccataagcaaaataaacttctattctttataaattacctagtctgtggtattctgttatagcagcagaaaacagactaagacactcatgaaatatatataacaaaccagcgttatgtgcacatatgcacaaatgcactcatactggaggatacagtgagtgtttgagtttttatatcttgtagttgttcatgcaagatggtttatggagttgaaatttgtcatccatataagtaatgtactacttgaaattggacaaagtatggagaagagccttaaaaatcattgaaaaaatgaggtgagcttaaaagaatttaatatgtgtagctcagggaagctgctgtttaggagaagtgggaatgtgcctctgcttcaggactgtaagtccccaaagagtaatttgcaggcagtaagaaggcactacagagaaggaaatgggcagaaaggaattgaagtgtgtcttagtttgctcaggcttccataacaaaatatcacagactaggtggcttaaacaacagacatttatcctctcatgttctggaggctggaagtccaagatcaaggtgctggctgatttggttctggtgagggttccaatcttggctcacagatggctgctttcttgctgtgtcctcatatagtctcttctttgtgagcaaagaagaaaaagaatgaaaaaaacaaaaaaagaaagaaaaaagaaaaataagaaaaggaaaaagaaagaagaagagcaagaagaagagctctgttatctcttcttttaaggacctgccctgatttaattgaggttaaataactgtatgacttcatttaaccttaattacctccttgtaaaccctatctccaaatacagtcgtattggggattagggtttcaacttatgaatttggtggagaaacaattaattccatagtagagtggaagctataggcagtagaatgacctcccagggaaacaacggggacagtgatgctattcctgaggaattaaaagtgcattgggctgggccagttccacaatatgctgtaggaagggcttccttccctcctggccctttggagatgtgaggaagggactgacagactaaaagctttaggttgcttgggagatatcgtctgataaaaactttaatctggtaaccttcctctctctttctctctctacctctcactctctctctgtctggctctcttaatggaatgctagtgtattcttattaggaagatagaacttggttaggaaggaaggaagaaaaacggcaggcaggcaggcattggagccagcaggactgggagatcacaaccacaatctcctgggcaaaagaaaggggaaatgagaagcagtgctttctcagtcatgcgagtagttactggcagtttgttctggccagcagaacttctgatatcatggctattgaataacttatcatcaaagtttaatgtgaaaccaggtgactgataactaaatctaggaacagaaatagaatcttcattttttctgcctgaagaaacttttttctgtcatttgatttaaaggccaaaggctattcaccataccactgagaattataaaacctttatgaaaactcatcacagtgttgaattgaatgtgtgatagagaggaaagctgggataatttcaatccttacccgacccatcttaataaggtaaagactcctgtgaaagctaccatactcaacgcagtgagatcacagcatagccgatttttttttttttttttttttttttttttacctctttctaggttgaatggaaatgaggcagtagccaaaggggatagaaataaacgttcttctcttactgtgattgtgtggatctgatgggcttttcaaaatggcacatgggtcagtgtttcttggagcctggactagcataccctcccggcatcttaagagaaacaatctccaggcttggtagaagtccttggctttcttgcttagaaatgtcagaagccaatgaatatttacatccccatctcacctttgctctgatttgctaatctgatccttatcaaattaggccaaaaggaaagcagttagaaacttgaacttccattgttagataagtaccaatctctacattaagagctatacagatacttgtaaatttctcactgggacacagaattggtacatatctccaggtgatcctcttctctcagcatgtatattcttctctcatgtagaaatcagttgctttgatggtcagaaagagacaaagagaaacaaattcatcagtctgtattatatcacagtagaatacaaggctagaaagtaggttcaaccctgttggaacccagccggtctgctgccctcgctgagtttcagggtccctgtctgcatatctggaaaataagttcatctttcctaaagacccatccaatctttgattctataatcataagtagggtgataagattttatttcctacttagagggccacctggagagtacattctgctttaattttctgttttggtgatggggaatttggagccatgcatggttatgaaaggcccagagatggaatctcatctctgattcaaggctttggttcctggcttcctgctgtattacttcaatgaaaccaaaccttttagggcatatgtctgcacatattggcctactcaaaatgccattctatcctgggcgaggtggctcacacctgcaattccagcactctgggaggccaaggtaggaggatggcttgaggccaagagtttgagaccagtctggacagtatagtgagatccaatctctacaaaaaatagaaaaattagctgggcttggtggcatgtgcctgtagtcccagctacttgggaggctgaggtgagagaatcccttgagcccaagaggttgaggctgtagtgagctatgatcgtaccactgtgctccagcctggatgacagagcaagaccctgttgcttaaaaaagaaaaaagaagcaaaatgcctttccgaatgatcccattgactgggcagaaatgttacattgttaaaatattttgtgccagccgcagtggctcacgcctgtaatcccaacactttgggaggctgaggcgggcggctcacctgaggtcaggagttcgataccagcctggccaacatgatgaaaccctgtctctactaaaaatacaaaaaaaattagctgggtgtggtggcgggcgcctgtaatcccagctactcgggaggctgaagcaggagtttgagaccagtctatgcaaaatggcgaaaccctgtctctactaaaaataaaaattagccgggcatggtggtgcatgcctatagtcctagctacttgggaggctgaagcaggagaatcgcttgaacccaggaggtggaggttgcagtgagccaagattgcaccattgcactccagcctgggcaacaagagtgaaactctgtctcaaaaaaaaaaattttttttgcacagtcttctccatgagatttatactcctagagagcagagataacaacaagcctataaggcaaggtagtattgttttatttagtgcctgcctattaccaaaagagtttgaagcagtttatactaaaaacataagaagaataatcttagaaacccaggaagaaaatttgggcagagaagtctctgggaagcatcccaaaactaatggctactgaaaataaacctctctaaacccttctctgtctttctctctcctttctttttctttctccttcccttcttgatttgtattgtgttttctcaattaattattttctctttcctatcccttctttttttcctatttggtttcagacgaattgagccaggtttctgaaacctgaagccaaaagcacctgtattagtctgttcccacactgctataaagaactacctgagactgggtaatttatgaagaaaagaggtttaatgaactcacagttccacaggctggacaggaagcatggctgggaaggcctcaggaagcttacaatcatggcagaagttgaaggagaagcaagcaccttcttcacatggcagagcaggaggaacagagagcgaagggggaagcactacacgcttttaaaccatcagatctcatgagaactcactatcaagagaacagcaagggggaaatccgcccccatgatctaatcacctcccaccaggtccctccccaatactgggaattacaattcaacttgagatttgggtggggacacagagccaaatcatatcagcattctaatggatacatcaatcgattttcatggcatgacattaggtatgaactattatcacccccattttacagatgaagaaactgaggcacagaggggttgaagatgaagacttgcctaaaatcaaatggtaaatggtggagtgaggattttgatgaagatagtctgaagccagtagctacatcattaattattataatatatactgccaagtatgaaatcagattttaaaccaggtctgtttaactcaaaccccattgatcttgactattaaactatgctccctgtgatgaaaatgatgatgaccatgacaatgacaataacagtaataattataactgacatttattgagcttttatagtgtgtcagcattagtctaaatattttttaaaaatcaactcattttcacaaaaaccctatgagtcaggtactactattatccacattttagaaatatttatttctattcatattcacaaacaagtataggtcatttaaaaattctagttaagacgtaattcacataccataaaacttaccttgttaatcattttaattattatttgattaagaaataatacacatcgccataaaatttacaactgtatactttgtacaattcagtgatttttgtatgtccactatgttgcacagccatcaccactgtctaattttagaacattttcatcacccctaaaagaaactctgtatccattagcagtcaccctccactcagcccttggcaaccactaatctactttctgtctctatggatttatctgttctggacatttcatataaatgaaatcatacaatatgtgaccttttgtgtccagcttttttcacacagaacagagaaaaacagctaccatttattggttgccatgactactatgtcctacgcactgttattgagagctttgtgtgccttatctttaatcctcacaataaccctgtggcagagtagcactatcatcttcatgttaatgaggagaccgaggcacagagctgttcagtaacttgcataaagcgcagcagcgcatacatggaagagttaaaacgcaaatccaggtctgtctgtatccaaatcccataccctttacattccatctttctgccttagcgtcacatggatgtgggccagtaatgtggtggcattgcagccagggcaaaggagttgagccaaccacgtggtgctgaaaagcatagccctaagatctcctggacctggtgtcttttagtggggtgggggctggggatgccctatctcaagcctgtgctcctgaccccagtaaatttgcctgctgaggtcctgcttgcttacttcttcctgcagcttcttggcggccccagctgcagtctttggttttactcaatttggatgtgtaggttacagagtttgtatggtagagtgtctgtatttcttcatctggctttggttacacgtggaaacatgacaaagcaagtcaagctttctatgaagagaaggacaaaaattcactgaacttattcaagtattcccctgaagtctgcagctcaggcacatttccatctggagcccattgaatagcaccagctccccttctctggatgggcatctgaggatgaacttctggtcttaagtgatcctccacctcagcctcccaaagtgctgggattgcaggtgtgagacattgcacttggcccaaaagcagatgtttatactaataggtatggacaatgaagaattaagtggtgatttccatgctctttataagatggcagagaaatgaatactacttttctaaaaatagtgcctgccaaaagagtttgtttcaataatttggaaaatgcaggtccaaatggctcattctttcagattgctgaactgatttgctgttattgcggctagaggcctctaagagtcactgttgagctctcagaggaatgtagaagctgacaggaaagagagggtctagaaggaaaccttatcttatataaccagaaaatatttatcaaatgtgacgcattaatcttgatacaatattattaaccaaactataaaagttattcagatttcatcagtttttccaggatccattcaggattccccatggtatttatcatcttagtcacatcatgtctccagtctgtgacagctcctcggtcttttcttgttttccatgaccttgacattttagtggtcaggtgttttgtaggcagtccctcaatttgagtttgtatagtggtctgtcatgattagaatgaaatagaaatttctcataagactgaaataggtttaagttagtggagccctcttggggctaaatttaagaaagggagaagttaattttctttgccctgctgcacctcctgcatcttgccctccattcccatctccagttcacttctctctgccctcagtggccaagtcttaataaacacttatgcttgctctgtgtccaaaccaatgataagcgcttggggcactgcagatggaaggtgtctgcctccattcctctttctcttctttctttccatttcttttctttctttcttttcctttctttctttttctttctctctctcctgtttttctctctccttctgtctctctgtttctctctctttccttctctctctttctctctcctcctctctctgtctctctctctctctttctctctgtctcaacaggtgtcctcaaactctaggaatgaattccaatatcctacattgtgaccagaaggaggccccacagtactccttctgaaagggtttgagcagagggcagtcagtcccgcagctgtaattcatcattacatcactcattgtgtgaaacacaataatgtcccattagcaaagtattaaatctgaaatgtttgtactgaattctggagaaacttcctgaggttaccttcccaactgggtggtgtgatgtttcatctcagtggttctgatttttcttactttcggtggaagggggaatagtaacttagttttctggagtttccagagggatgggaaatattatgaaatcaacaacgttgcagctcagaacatgatcctttcaattttcaccagtggctaaaatttattatctttttctgataaaagtttggggcttttaatcacagctccatcgagcctcaaggctggaggaagatcttccagtccttgtcacagtcctgtcattttacatatgaaatcaccgaggccagagagggaaaaacaaccaattactcaatcaatgaaatctatattgcttgttttctgtgtgctcagttctgtactgactggtagaagggtatataggcttataggacattgtccctatctgtaaaaatcttcaagatctagcatgggggtgtttactattctgtttaaggtgagcaagagcaaggcagcaattatggcattgatgctaagtatcatatgaattcatagataagtccaacaaaagcttgaaaaggccttaaagtggggtagaaattgaactggatatgtcacaattgataggatttagagagaggaaaaagccagacagtggaaggctccaaaagccaaacagaaaaggttgaaagatttgaagcaagagtgccatgagggggccagtgtggggtttttttattttcttgtttgttttgagacggagtctcactctgtcacccaggctggagtgcagtggtgtgatcttggctcactgaaacctccgcctcccgggttgaagtgattctcctgcctcagccctcctgcgtagctgggattacaggcacgtgccaccacgcctgactaattttttttttttgtatttttgatagagacggggtttcaccacattggtcatgctggtctcaaaatcctgacctcatgatccacatgcctcggcctcccaaagtgctgggattataggcgtgagccaccgcgcccagcctcttgattgtttttgagacaggctatcactctgtcgccttgctggagtgtagtggtgcgatcacagctcactgaaatcttgacctccccagggctgagtcttccaagtagctgggactgtaggtgcatgccaccatgcccagctaatttttcctattttttgtagcgaaagggtctcactatgttgcttaggctggcctcgaactcctgggcccaaatgattcccctgcctcggcctcccaaaatgttgggattacagacatgagccaccatgcctgggtgaggggagcagtgtttacagaaacttaatctaattgagatgtgcagtgggatcaactgtttcgagtgggagagtcattgccaggcaagtgtgacatttattctgtgcctctcagaagcagcaccaaagcactgtggtccactagtgaaactagaaatcaggtaggaaagaaaaattctgctatatcgaggcagcaggagagactttttgtagtaaatgtatccttgagtgttccttaaattttaatagaaaaagtacattggttaacatgtttaaagtgcttattatgtgctagccattgctatgtgtgcattggttcacgtaatctctctgatacagacgaggaaactgaggcttgtaaaataagtcgctccccttaaatcataaggccagaagatagcaaagtaaactttcctaaatagacctgtctgatttcagagtccctatctcctgacaccctacacgtggcggcattatttcttccatgttagagctggaggaaattctagtccaaactcttgttttaatgaagagcaggccaaaggccaaacaatcagagtggtgcacctaatccttgatcattttgttcttaaaaatgttggtgcctctgacatcaggcatctggatgctggggatggagtatctggtcctgatgtcacagagtaacttaggggaacaaaccctctctaaaagagttcaggctttagactttctgactaacattggggtccccatattattcagtggctctttcccctccagttatgacttgagatctggttctggaaaaggctgaaagggaggccttcctggcaggaacccaagactgcatactccatgcacctggagctgggcagtcattgttggggatggggggaatagatgttatcccaccttcatattttgattcctgtgactctgaaggcttttctgtttggacaaatatatcatctaacgtggccagtgtgtgtcattgggcaaattgcttgccttttctgaatgtcagccttttcctttgtaaagtaagaatagtgatcatatctacctttttagggttgtgggtgtgagaatggaatggctttggttaagtgtacaaagtagacactcaatgaatgttagatccctgaaataccttggtaggaaaggcagtgggtgaaaaaatggcaagatcacttaatttggaattagacaacattgatgatgcatttaggattatcaaacttgggtgtgtggtcttgggcaaagcagctaagttctggctgtagtctcacctgaaaaacaaagaagctcattctaaatggagcacatgctaatcattaagaaactaaatggtatgcaaagctatggagaaggagaagcagataaaaaagggaagggagaagggaattgtcaagaaatccactttgcttttgcacatctcacatatttgccaaaagcctctgctttcatggagacatgagtctaataaaaacataactgttgtctctaaggttagttactacaaaaaaaaaaccccacacaaacataaaacctataactgcaaactacaggtagttttagagagacttagccataacagtaatggtaatatttaccattttttgaatgtatgctatgaccaataactgagctggatgctttacacacagtatatccattttttcctagcaatcctgcaaggtgagaattattgaaaacagtttacaggtgaggacaccaagttttcagatatgttaagctaatcttccaggtctcctgcagatgaaaagtggtggagatgggattccaactcaggtttcttgggcttcaaatgagttgctctttcccttatgccaagatgtttttcatttgtatcaagtgctaatctttaaagttggtctgattaagaggctccctttattttcagaagctgtagccagatcataaagccttcctggtgttcctttttagggatgtttttcagaaatacacaaagaagtcagccatgttgctttcaatgatagcctgtttaggggccacatagtatcttacctttgggttccctaccttattcaccacatatgactccaaacataactgaatggtttctgaaatgaaaattcacactcaaaagacatacctttgctacagttgtaaatatttgaaaaaattatgctttgcaatttgaaggcagtttcaaaaagaggtgttccagaaatgcctttagtactggcaacaccattgagaacgtaagatgactgctttagaaatgaacaaacccatctggaagttgaagtattgacatggagactaaaaacaacaagatataattcctccccatctcccaccccaaccaaggtattccatgtctgtaagatgagtgggctgtaaatttgtgtgtgcgtatttggggtcccccaacataatagaccacaggagactgggagacagatgtggagtttccccttaatcttctagtacctgagttccttgccctaaacctagatgatggtttttaactgcagagtcttgattttttaccttgtgaaatctagttgagagcctccagctgctgctctggttgatatggaaatgcaagggtggggagatacagccctagccacacagaatctctctagctgtgggcaataggcctggcagaacctgaagggggcccagaacactcttgtaggacacagtttaaaaaccactcctgaggccggtcatggtagttcatgcctgtaatcccagtactttgggaggccaaggcaggaggattacttgagctcaggagtttgagatcagcctggccaacatggcgagaccccatctctacaaaaaaaaaaaaaaacattaaaaattagccaggcctggtggcatgtgcctgtggtcccagctacttgggaggctgaggtgggaggattgcttgagcctgggagtttgagactgcagtgagctatgatcacaccactataccccatcctgggtgacagaccaagaccctgtctctaaaacaaaaacaaaacaaaatgaaacaaacaaaaaacactgctgaggtaattcatggggtttcttggtgattttttttccatgtaggaatcctgtataccagttcctatactgttggaccttagtttcctcacctaaaaatgaagaatctctcaagtctcctcaaattctaatgatttgggattctaatgtgatctaataataaccaggaccaggcagtgaaaatgagaaacctttgctgacagaccttcccatacaaggctttagctcattcctaatgggggctgaggggacaagctctgtggggctgaaatgcaccaaccctcctgctaagtcccttcctccccatggcttctaatggttaatggacagctgactccatgatacacagatctttccagcaagtcttctgtcttgtttttactgccttggaattgtggaattgctcaaccgatgcacatgtggctcatttcactcattcacaacaaaaatgcaactcctgccaagtcaacagaatgcattaaatacacccaaattatacaacacatccaacaagtatttgccaagcacagtttaatgctcaggaggtggctgatccaagagaagaaaaaccaaagctcttcaaagataatatataatacatcttcattaaaagagaagataaaaaatagaaaaatgggctaaggacacagacagttcaccaagtacaaatagttattgtttagtcttaaaaaaattaatcttccaggacatccagccaagtacaaatagttattatgtaaaagtaggggtctgcattgtgacctctatcttgttatatgatctggagcaagttacactgtctggcaccagtttcttctttaaaatgtccaggtttggctagatgagccttaaggtccgggttctaaaattctcttgatctcttttttgtattaaacacagaagaataaaaaaagatgcctcttagaaaaagtaacatccggcataggtcctgctcctgaagaaggataaagaatctgattgaaaggcaggttggggctgcatcgtgaatggccttgaaggacatttaaagatgtttggacattatctcattgccataaagaatcactgaaaattttagatcagggcagtagtgctgagaaaagtttgagataatataaaaataaatccctacgaagaaagggtaatagaatgaggacagtatggaaggagtcagagaggtcttcttggcagactctaaaagatttgaactataccccttctgtttccacagatgcaattgttttattttgtttttaataatgtagcattgaatatcatcatttacaagtttttactttttttctgcttcatttttccttcatatgatttacaagtttttagttgaaaaagtaaaatacagagaaagatagaaaattccgtttcctccttctcacatttttttggataaattatatatttgacattttaaatgtcttctcagagaagaggagccattcagtatcagcctgctggcattgctgtccttagggaagtagggactctggagacagaatgctctagctcctttatggaaatcaattgattgaaggatagaataaagtgatcttctcaacattgatttaatatgaacacgttttattgacagcttctaaaacaaagtctggctccactctttaccaaactattcgccctctctatgcctccgttttcttatctgtaaagtgagctaataagtgtacctacctcatagggttatgaggattaaacaatgtaatgtttttaaggtaggagttttcattatttggtaaatgctaaggggaaaacagcttcactgtttagaaaaaaataataaatgcaacattttaagattgcatttcatactttataccaaaataaattccagatgaattaaaaatgaacatatttgaaaagataatgtataatacatcctcatttaaaaagaagataaataacagaaaaatgggctaaggacacagacagttaaccaagtacaaatagttattatgtaaagtatacagccctttaactttggagtttcacttcaaagaaaatacagatgcacaaggatgtactcataaggatttcattctaaaatatgaacagaattacactgtagaattatagatgagtttttaaaatttctgttttgtgtgtctttaattttttaatttttatgggtatataataggtgtatatatttatggggtacaagagatattttacacataggcatgtgtagaaaattggctatccattctctcaagcatttgtcctttgtgttgcaaacaatccagttatactcttttagatattttaaaatatacaattaaattattttgactatagtcaccctgttgtgctatcaaatacgaggtcttattctttctaactagtttttttggtacccattaaccatcctcatttttccctcaaccccccactacccttcccagcctctggtaaccatcttcctattctctgtgtccatgagttcaattgttttgatttttagatcccgcaaataagtgagaacatgcgatgtttgtctttctgtgcctggcttatttcacttaacataatgacctccagttccatccatgttgttgcaaatgacaggatctcattctttttcatggctaaatagtactccactgtgtataagtactacattttcttttcttttttaaattaaattaaattaaattttaacttttgggatacatgtgcaggatgtgcaggtttgttacattggtaaacaagtgccatggtggtttgctgcacctataaacccatcacctaggtattaagtccagcatgctttagctatttttcttgatgctctccctttctccatccccctacaggccctggtgtgtgttgttcccctccctgtgtccatgcgttctcatttttcagctcccacttatgaatgagaacatgcagcttttggttttctgttcctgtgttagtttgctgaggaaaatggcttccagctccatccatatcccacaaaggacatgatctcattcctttttatggctgcgtagtattctatggtgtatatgtaccaccatggtacattttttaaatccagtctatcattgatgggcatttgggttgattccatgtctttgctattgtgaatagtgctgcaatgaacatatgtgtgcatgtatctttgtaatattgtaatatcataaagattataatagtagactgatttatattcctttgggtatataccaaaggaatttcattactgggtcaaatggtatttctgattctaggtctttgagaaatcaccacgctgtctttcacaatggttgaactaatttacattcccaccaacagtgtaaaagcattcttatttctccacagcctcgccagtatctgtggtttcttgactttttaataatcaccattctgactggtgtgtgatggtatctcattgtggttttgatttgtatttcactaatgatcagtgatgttgagctttttttcatatgtttgttggacccataagtgtcttcttttgagaagtggctgttcatatcttttgcccacttttgaatggggttgtttttttcttataaatttgtttaagttccttgtacattctggatattagacctttgtcagatggatagattgcaaaaattttcttccattctgtaggctgtctgttcactttgatgatagtttcttttcctatgcagaagctctttagtttaattagatcccatttgtcaatttttgcttttgttgcaattgcttttgatgtttttgtcatgaaatctttgcctctgtttatgtcctcaatagtattgcctagattttcttctagggtttttatagtttggggtagtactacattttctttatccattcttctgttgatggacatttaagttggttccaaattttggctactgtgaacagtgctgcaacaaacataggaatgctgatatctttttgatatactgatttcttttcttttaggtatatacccagcagtgggattgctggatcatatggtagctctatttttagtttttccaggaacatctaaactgttctccatagtggttgtactagtttataatcccaccaacagtgtgcaaaggttcccttttctccacgtccttgccagcatttgttattgtctgtcttttggctataagccattttaactggggtgagatgatatttcattgtagttttcatttgcagttctctgatgaccaatgatgttggcaccttttcatacgcctgcttgccatttgtgtcttcttttgagaaatgcctattcaaatcttttggcatattttggttggattagtatattttttcctatagacttgtttgagctccttatatattctggttattaattccctgtcagatgggtagtttgcaaatattttcccccattctgtgggttgtctcttcactttgttgattgtttcctttgctgtgcagaagcttaacttgatgtgatcccatttgtctatttttgctttgggggtattactgtgcttgtggggtattactcaagaaatctgtgcccagaccaatgtcctggagatttccccccaatattttcttgtagtagttttatagtttgaggtcttagatttaaatatttaatctattttgatttgatttttgtatatggcgagagacacgggtcgagtttattcttctgcctatggatatccagttttcccagcaccatttattgaagactgtcttttcttggcacctttgtcaaaaattagttagttgtaggtgtgtggatttgtttctgggttctgtatgctgttccttgggctatgcatctgtttctatgccagtactatggtgttttggttactatagctctgtagtataatttgaagtcaggtaatacgattcctccagttttgttctttttgcttaggatagctttggctattctgggtcttttgtggttctatataaatttcagggttgttttttctatttttgttaacaatgtcattggtattttgacagggattgcattaaatctgtagattgctttgggtagtatggacatttttgcaatgtttattcctccattccatgaacatggaatatctttacattttgtgatgtcctattcaatttctttcatcagtgctttatagttttcattgttgagatctttcacttctttgattaagttaatttctcaatatttaattttatttgtggctatggtgaatgggattactttcttcatgtctttttcagattgttcactgttggcatatataagtgctactgatttttgttatttatttactagttattttgtggtcttctctttcttctttctttcctatctttcttttaatgaagttgactttctctgatgatgtgatttaatttcttgctttttttgtatctgttgtatgttttcttatttgaggttaccatgaggcttgcaaatactatgttataacccattattttaaaagatgacaacttaacactgattgcataaacaaagaaacaaacatgcaaaaagaaaagtaataaaaactctacacttaagctttgttcccctactttttaaactttttgttgtttctcttatgtcttactgtcctgtcgatgtcttgaaaagttgttgtagttattatttttgattggttcatttagtctttctacttattgtaagagcagtttatgcattacaattacagggttataatattctatgtttttctgtatgtttactattaccagtgagttttgtaccttcagatgatttcttcttgttcaattaacatcattttctttcagatgaaagaactccctttagcgtttcttgtaggcacaggtctggtgttgatgaaattcctcagcttttgtttgtctgggaaggtctttatttttctttcatagttgatggatatttttgctgcatatactagtctagggtaaaagtttttttccttcagcactttaaatatattatgccattctctcctggcctgtaaggtttccactgaaaagtctgctgccagatgtattggagctctattgtatgttatttgtttcttttctcctgctgcttttagatcccttttttatccttgacctttgggagtttgattagtaaatgccttgaggtagtgttctttgggttaaatttgcttggtgttttataaccttcttgtacttgaatgttgatatctttctctaggtttgggaagttctctgatatccctttgaatatactttctaccccatctctttctctatctcctccttaaggacagtaactgttagatttgccctctcgaagctgttttctacatctcttaggtgtgatgcattcttttaattcttttttcttttggtcgcctctgactgtgtattttgaaataggctatcttctatcttcaagctcactaattctttcttctgctttatcaattctgctgttaagagaccctgatgcattcttcggtatatcagttgcatttttcaactccagaatttctacttgattgtttttaattatttcaatccctttgttcaatttatctgatagcattctgaattccttctgtgttatcttgaatttctgcaaaatagctattttgaattctctgtctgaaaggtcacatatttctgtttctccaggattggtccctagcaccttatttagttcacttggtgaggtcatgttttcctttgtggtcttgatgcttgttgatgtttgtcagtgtctgggcattgaagaggtagatatttattgtattcttcacaatatgggcttatttgtgcccatccttcttgggaaggctttccaggttttcaaagggacttggaccccaagcccaataacactgtgggtttgtcagactcatagaggtaccactttggtggtcataggtaaaatccagaataattctgtggattaccaggcagagttacttgtactctttccttactttctcccaaacaaatggagtctctctttttgtgctgagccgcctggtactgggggtatggtgatgtaagcacccctgtggccaccaccactgggactgcactgggtctgacctgaagccaacacagcactgggtcttgcccaaggcttgctgtaaccactacttggctaccacctatgtttactcaaggccctagggctctatgatcaacaggtggtgaagccagccaagttttgtgttctttccttcagggtggtgagctgcccctggccctgggtgggtccagatatgctatctgagagccaaggattagagtcaataatattagacatttacttgatgttttcttctactgtggctaagctggcactcaaaccacaatacgaagtccttcccactcttccctcctccttccacaggcagaggagcctctccctgtggctaccaacaccatagcccacaggggtttctgccaggccatgctgatgtgcacctaaagtgcaagggccaaggactcttcattcagcttgtggtgaactctgggaggcctgagacttactttcaggacagtgggctcccctctggcccagggcaagatctggaaatgctgtccaagagcctaggcctggattctgggaccccaagagcctgcttgttgctctaccccccaatgtggccgagctgctacctaaggggcaagacaaagtcccctttacttttccctctgcttttctcaagtagaagtctttcaccatagccaccacaacttgaatatactggttcacactggaagccagcatgtctcagagtctcagccaaggtccattgtgtactacctgggtattgctgctggttattcagggcccaaaggctctctagacagcaggtgatgaatcctgccagaactgggttcttctcttcaaggcagcaggttcccttctggcccaaggtgggtctagaaatgtcatccggaagctaaggcctagaatgggggactcacaactctgcctggtgccctctcttactgtggcagagctgatatccaagaggtaagacaaagtcctctttaccctttgctctcctctccttaagccaaaggaaggagtcatctttgttgctgtgagctgcacttcctggggttggaggagagatggcacaagcactcctttagctgccctggctggtgtttctctaggtcacaggccaccctagtccactgacactaaacccagcctagcactgggagttgcctaggagttgcagtccttgtatcctagactgcctttcaagtctacctagaaccccagaacactttgacccaccgcagtgaggcttgccaagaaactaatgtcttgaccactgagatgaaccattcccctctggctagggctggcccaaatgctccctctgttcatgggtgctggctgagcccagcatggctttgctctctactgtgacaaggtggcactgagttcaatgtaaagtcccccagttgctgcactctccctcccgcaagttcacagattctctcttcacacagcatgactgctgctgggggatggaagagaggtggtgtcagagactcaagactgtccatcctaccctcttcaatgcctgtttcagcaatatgaagttaaagccaggtactgtgattgctcacctgatttttggttcttgtgaaggtaattttgtgtgcagatagttgttaaattttggtgttcctgtcgtggggagagatgaatggtggaggcttctattctgccatattgttctactctcctagattagatggtttttttttttgtttgtttgtttttttagacagagtctcgctctctcgcccaggctagagtgcagtggcatgatctcagctcactgcaacctctggcaacctctgcctcacggattcaattgattctcatgcctcagcctcctaagcagctgggattacaggcgcccaccaccatgcctggctaacttttgtatttttagtagacacagggtttcatcatgttggccaggctggtctcgcactcctgacctcaagtgatccgatcacctcggcctcccaaggtgctgggattacaggagtgagccactgtgcctggccctagatgagtttttaattagtcttattccacctcctcctccttcttttactacaaatatgtactactttcctcctcctcctcctcgtcctcctcctcctcctccttcttcttcttctcctggacaaaatggtgaaaataaagttttccttcactttgtgaaatctcgttctttttccactctatccagtatgtccccacttccagtccaattctccacatggtttcagatattcagctccaactcttaggcacatctggttcataatccaagtcacagattcatcacctgtcagccattgtggtacctccaaactttgccaactactcccagtactcattgctattggctaaaagaaggggacatagttgtgtgaggcaatctccattcgtccatgaataaaacagaacatggtttgtgctgatggaggaaggggggtcagttgtttttatctttgcatgggagagattacactctgcattatgatgaagtgattcatgtgtcctaagtaaagtggcgtgcttttagagggacgcggaatggccaacatctggcattcctgccagcagcctccatggctattcccttggagaacatgacaagtctgttaacagcattctttccagctgatccctaatgcaaccccagaatcttgacccaggaatcctgggcacaatgctttgttctagcacctcaaaatatgatcttagcatcagacaggagcttattaaagatgcaaattctcaggccccactctaaatttactgaatctgaatttggcctcactttcaggaattcttggtctctttacaagctgtggcagataattacctaaatataacccaatcacccactcatttcacggagtggtttgtggtcagtttgcattaaatcatctgggatatttattacaaaagttgattcgtaggttcttcctgagaacctaggataatgccaggaatctatatttttgacaaatgtcctggagtattattcttaaatgtaaactgatgtggtgggattctaagtaaacatggctgtttctctggaatgcaatacactcattctaacacacaaggtagacagggtggggtgaggcagtggtttccctaggtgtatgttgaaaaaactcttggagccgggtgcggtggctcatgcctgtaatcccagcactttgggaggccaaggtgggcagatcacttaaggtcaggagtttgagatcagcctggccaacacggtgaaatcctgtctctactaaaaatacaaaaattagccaggcatggtggcatgcacctgtaaactcgggaggcaggagaatggcttgaacccaggaggcagaagttgcagtgagctgagatggtgccactcttctccagcctgggtgacagagctagattccgtctcaaaaaaaaaaaaaaaagaaaaagaaaaaaagaaaagaaaaaaaagacataaaagaaaaagctcttggtctctctgaagtcaggccaaggcataaattatctagtgcatgaatgtggaaaatacaggctgtggagtcatacaccatttactaggtgaatgtaattttgttgagccataactataacattatgataattatgcctggcctgtcatagggagtattctggcaagtttctggtgcatagtaggaactcaagcttttttgtctattgatgtgtactagtatttccatttattcatcattttgaatatacaatcaataacacaaataattaaataatagttaatattgagtgttaattatacaccaggcactacatgaagcatttaatatacattatctcatttattctttacaaaaactctaccagggtggtattattattctcttcatttgacagaaaaagagaactgagatgtggggtgcagccaaatgctcctaaggtcgctaagcctagactctttcaagcgtatttggcaccatgctagcttggtgaaggttgaaatgatgtaagagacaaggtcttggaaaaaatctttttataatcttgaaggaaagcaagcccatgcaaacaaataaccaagatgaagacatacccagaacttccaaggggtacacatggaacatcatagactttcagaggaagaagaggccactttcaagttcaatggtcagggcagatttcatgaagaaagtgctcttaaatgtaacattggaagatatatagggtcctggtagaaagggattgaatgacttaccacatggaaagtataaagctcttaaatagagggctggacatggtggctcacgcctgtaatcccagtactttgggaggccgaggcgggcggatcacgaagtcagtagatcgagaccatcctagctaaaatggtgaaactctgtctctactaaaatacaaaaaattagccaggcgtggtgacaggcgtctgtagtcccagctactcgggaggttgaggcaggagaatggcgtgaacccgggaggcagagcttgcagtgagccgagattgtgccactgcactccagcctaggtgacagtgcgagactttgtcaacaacaacaacaaaaaaagaatgcttgtgatttttgcacattgattttgtatcctgagactttgctgaaggtgcttatcagcttaaggagattttgggctgagacgttggggttttctagatatacaatcatgtcgtctgcaaacagggacaatttgacttcctcttttcctaattgaataccctttatttccttctcctgcctaattgccctggccagaacttccaacactatgttgaataggagtggtgagagagggtatccctgtcttgtgccagttttcaaagggaatgcttccagtttttgcccattcagtatgatattggctgtgggtttgtcatagatagctcttattattttgagatacgtcccatcgtacctaatttcttgagagtttttagcatgaagggctgttgaattttgtcaaaggccttttctgcatctattgagataatcatgtggtttttgtttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggctgtgtctctgccaggctttggtatcaggatgatgctggcctcataaaatgagttagggaggattccctctttttctattgattggaatagtttcagaaggaatggtaccagttcctccttgtgcctctggcagaattcggctgtgaatccatctggtcctggactctttttcgttggtaagctattgattattgccacaatttcagatcctgttattggtctattcagagattcaacttcttcctggtttagtcttgggagagtgtatgtgtcgaggaatttatccatttcttctagattttctagtctatttgcatagaggtgtttgtagtattctctgttggtagtttgtatttctgcaaaatcaatgtgcaaatataacaagcattcttatacaccaataacagacaaacagagagccaaatcatgagtgaactcccattcacaattgcttcaaagagaataaaatacttaggaatccaacttacaagggaagtgaaggacctcttcaaggagaactacaaaccactgctcaatgaaataaaagaggatacaaagaaatggaagaacattccatgctcgtgggtaggaagaatcaatatcgtgaaaatggtcatactgcccaaggtaatttatagattcaatgctatccccatcaagctaccaatgactttcttcacagaattggaaaaaactactttcaagttgatatggaaccaaaaaagagcccgcatcgccaagtcaattctaagccaaaagagcaaagctggaggcatcacgctacctgacttcaaactatactacaaggctacagtaagcgaaacagcatggtactggtaccaaaacagagatatagatcaatggaacagaacagagccctcagaaattacgccacatatctacaactatctgatctttgacaaacctgagaaaaacaagaaatggggaaaggattccctatttaataaatggtgctgggaaaactggctagccgtatgtagaaagctgaaacctgatcccttccttacaccttatacaaaaattcattcaagatagattaaagacttaaacgttagacctaaaaccataaaaaccctagaagaaaacctaggcaataccattcaggatataggcatgggcaaggacttcatgtctaaaacaccaagagcaatggcaacaaaagccaaaattgacaaatgggatcgaattaaactgaagagcttctgcacagcaaaagaaactaccatcagagtgaacaggcaacccacaaaatgggagaaaatttttgcaacctactcatctgacaaagggctaatatccagaatctacaatgaactcaaacaaatttacaagaaaaaaacaaacaaccccatcaaaaagcgggcaaaggatatgaacagacacttctcgaaagaagacatttatgcagacaaaagacacatgaaaaaatgctcaccatcactggccatcagagaaatgcaaatcaaaaccacaatgagataccatctcacaccagttagaaaggcaatcattaaaaagtcaggaaacaacaggtgctggagaggatgtggagaaataggaacacttttacactgttggtgggactataaagtagttcaactattgtggaagtcagtgtggcgattcctctgggatctagaactagaaataccatttgacccagccatcccattactgggtatattcccaaaggactataaatcatgctgctataaagacacatgcacacgtatgtttattgcggcactattcacaatagcaaagacttggaacgaacccaaatgtccaacaatgatagactggattaagaaaatgtggcacatatacaccatggaatactacgcagccataaaaaatgatgagttcatgtcctttgtagggacatggatgaaactggaaatcatcattctcagtaaactattgcaaggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataataataataataataataataataaaaatctctaagtaagataaaaaaaagaaaaaagctcttaaatggaatctggcataaaggaaatgctcagtattttaatgtatctctactactctaggtattataatgtatctctactattgctattactattaccatttcccctttgtgtgtgtgtgtgtgtgtgtgtgtgtgtgtgtgtgtgtgtgtggtttataatgtttataacagttttaatggtttataacagtttataatgtgtattgtgaaagcctctacagaagccacttggtggatacaaactcatcaacctcatctcacccagagttcatttgtctctccatgaggtctttctgagagacttcatcaaagaccacattacagatatgaaccctcccctgacatgccactctagtcttcatccaaaatgactgtgaaaattgtgtgtgatatggtttttttgtgaactaatctacaacatcatgatgtttaggtggctacttccttcacagcctcccttggttttggagtgggggtcacatggctgccatgggtgctttttgatgatctcattgcagggaatttcttctgagtcttgtagcatctgttcctctgttcatcttgtcctcagatgtttgggtccatctcccctcaagccttactgagatatctcaaataatccaggacatgtgggcttcagagcctgcaaacctaattttagagcctggagtcctcaactcctggttgtgtgactatcttagtccatttttttgttgcttataaaagaatacctgaaactgggtaatttataaagaaaagaaatttatttcttacagttctggagcctaagttcaaggttgagggggcacatctggtgaagatggtcttgctggtggggactctgtcagagtccccaggtgatgcagggtatcaaatggcaatggggctgagtgtgctagttcagatctctcttcttcttcttatagggctgccagtcccactcccacggtaacccattactctattaacccattaatccattcatgacagcagagccctcatgacccaatcacctctcaaaggccccaccttgtgacattaccacattggagattaaacttggtggtgcgttgtgacacggtttgtcatcttggtgatgagttgtgacacagtttgtctctatgtccccatccaaatctcatctcgaattatggtcctcacgtgttgagggagggaagtgattggatcatggaggcagtttcccccatgcagttcttgtgataatgagagaattctcatgagatctgatggttttaaaagtggcagtttttttcctgtgctctcacttctccctcctgctaccttgggaagaaggtgcccttccatcatgattgtaagtttcctgaggcctccccagccatgcagaactgtgagtcaattaaatatctttcctttataaattacccagtctcacggaacttctttatagtagtgtgaaaacggactaatacacgtgtaaagctctggctcccagccatccttcaacaggaattttctgagtagctgttctgtgcccgggtgctgctctaagtgctagggatacaacacagaacaaaaccaacaaagtccctaacctcatcagagttgatcagtaaatatatagcacatcacagtgtagcaagtgctacacagaaaaataaggcagggtcaggggaaggactattctggtggtggagggattatatttagggtgagtggggaaggcctcactgccaggggtcatttgagcagagagcagagagaaatgatgatagagaatcacactctgaccttaggatttatatcttgtatgcttcccctgcctgggacactctatccccagatagccacatggctgactccctcatctcctctgggtctctttcttccatatcttcttcatggtgaggtcttctctgacacctttggaaaatagttgagcatcacaatcagtctctgcctcctcaccccatttaatttctctccatagaacttatcaccacctggcatatatttattatatgttaatttaatgcctgtttctagaacaggttggcaaaccacagcccactgtctgttttatttttatttttgtttttttgagatggagtcttgctctgtcatccaggctggagtgcagtggcatgaggttggctcattgcaacctctgcctcctgggttcaagcaattctcgtgcctcagtcacctgagtagctgggattacaggcgcatgctgccatgcccagctaatttttgtagttttaataaggacagggtttcgtcatgttggccaggctagtctcgaactcctgacctcaagtgatctgcccgcctgggtctcccaaagtgctaggattacagatgtgagccaccacgcctggccccactgtctgattgtgtaaataaaattttattagaatacagccacactcatccctttgtgtattgtgtatggtggctttcacactacaacagcagagttgaatggttgtgaaagagacagtgtggtcctcatagcttaaactatttgctatttggtccttcacagaaaaaaattttgcagacccctcttctacaatacaagccctgtggaagcagaaactttgttttgtttattgctgtctccccaggtcctagtacagcgcttggcatgtagtaggtcctcaataaatattagtttactgaatgagtgaatgaatgtaggagaagagtaatcagaataaccagaaaaccaggccagtcttgagtcttgaatgctgtgcttaaagggcttggctgttcttccctggtggttggggaaggggggtgtcccgtgaggaggagggtgagggaagctctctgggttctgtcagtgaagaggttaaacagctgtttctaccatgagattactattattcatgttgctattattcatacattactactatgcgtgtccaacgtgcatgttggagacatcatgtgtaagtatgggcatgtgggcaccatttttgaaaacctggtactattacccaaagtggaatagaggttgtttaagggcaggacccccagggtcaaaacatgcagtgggtgattcatgcttcccccaccaagcacctgtggaatctggagaatttaatgaacttccctatacctcagtatccttgtcttcaaaatgggatattaacagatctaccctcacagggttgtttatggatttaaggagttagttaatgtaaagtgtttggatcagtgacactcagtaaactattaatgaatattagtgattctccactattaacaactctccatgatgtccccccatgtgtgtataatgtcacatagtaaagaatttaaccttattcaaagagaggtctgtcctttgccctcagatttcagttggtaatctgtaagcccttgagctgtcatgcctgataggagtgcctttatttgcttaggggccctggaccagccagattgaagcaatgtgatttagggtaggggctttgagccacaccaaaaatgtgatttaggatagggaacttggtccagccagatggtaactatgtgatgtatagcagggactctgagccacaccaacagtggtgtgtaggataggggctttgggtcatgaagctttacctcctgagggctggaaaccgagatcagccatgtgggcagtaacagtccctacatgatggagccccaataaagactctggacaccaaggcttaggtgagcttccctggttggcaacactccatgcatattaatgccagcagagtaatgttgttctaactctgcggaagaggccaactggaaggtctgcgtttgccccctgcctggaccctgccctgtttgtctcttctcttggcttatttaaattttaacctgtatccattccttgtgatgaactatgtaactatgtatataaccgctttcagtgagttctgcaagtcactttagcaaattatcaaaactgagggtggttttgagaaccccctgcatttacaattggtgtcagtagtaacggtgggtttgtgtggacagttctctctaaatttgcggttggctttttgcaaatgtgcagagtgtgggcttccatgtatgcctggtccattcctggcctgacccctcgagaggcaaactgtcccaacacatcctcctcagggtacctgtaccctcttcagtttcctctgtcactgaggctgatgaggagacaaggccaccacatcagcatcccaggtataccattttctaggggctacaagactgggtgtttctgacctaaatgggaacctgggagggaagaagatgtgcatatcccttctttctcccccagacctttgtggtgaatgccctgtcctcacactgcagcctcacactggggccacagagatagacagatggggcctagtctatcattgatggtcatttgggttggttccatgcctttgctattgtgaatagtgctgcaataaaaatacgtgtgcatgtaactttataatagaatgatttataatcctttgggtatatacccagtaatgggattgctgggtcaaatggaatttctggttctagatccttgaagaatcaccacaccgtcttccacaatggttgaactcatttacattcctatcaacaatgtaaaaacattcctatttctccacagcctcgccaacatctgttgtttcttgactatttatttatttatttatttatttatttttatttttatttttttgagacagagtttcgctcttgttgcccaggctggagtgcagtgccgtaatcttggctcactgcaacctctacctcccgggttcaggcgattctcctgcctcagcctcccgagtagctgggattatgggcgcccaccaccatgcccggctaatttttgtatttttagtagagatggggtttcatcatgttgaccaggctggtttcgaacttctgacctcaggtgatccactcacctcggcctcccaaagtgctgggattacaggcatgagccactgcacctggccatttcttgactttttaataattgccattctgactggcataagatggtatctcattgtggttttgatttgcatttttctaatgatcagtgatgttgagcattttttcatatgtttgttggctgcaaaaatgtcttcttttgagaagtgtctgttcatatcctttgcccactttttgatggggttgtttttttcttgtaaatttgtttaagttttttgtaaattctggagattagacctttgtaagatgggtaaattgcaaaaattttctctcattctgtaggttgcctgttcgatctgatgatagtttctttttgctgtgcagaagctctttagtttaattagataccatttgtcaattttagctgttgttgtaattgcttttggcaatttcatcataaaatatttgcccatgcctatgtcctgaatggtactaaagaaaatgtggtaccatggaatactatgtagccactaaaaggaatgaggtcatgtcctttgcaggaacatggatgaagctggaagccgtcatcctcagcagactaacacgggaacagaaaatcaaacaccgcatgttctcacttgtaagtgggagttgaacaatgagaacacatggccacagggtggggaacaacacacactggggcctgtggcggtgggagaggagggagagcatcaggacaaatagctaatgcatgtggggcttaaaacctaggtgacgggttgataagtgcagcaaaccaccccatgtcacacgtatacctatgtagcaaacctgcatgttctgcacatgtatcctggaacttaaagtaaaaaaaaaaaaaaaaaaaaaaaaaggaaaagacagatggggcctactccaaggggaatgaggttcccctcccaggggaaagaaaaacatatcgatgcatagcaatgacaatagtcataatattacacattaataaaacatgtcaatcctctcattcttgtgcacacagctctgtgcacacgtgggtttttttaggacacattcttagaactgtcattgctgcatcaagggagttattcattcaacaaacacctaatgagtgcctgttttctgctgggcactgttctaggaagttgggagatgtcatgggcatgaggtccctgagttctttgctgtttttcttcagaacataagctctctgaactgctcaagtttttccgtccagagtttgtagtgtataagatattatggagtctgtgtcctgtatgaggtctttgaattgtatggtggggtctgtatcccagggagtgaggtccccgagctgttcggggaatctttgtccaggatatgaattatctggtacattgggagatctgtgtctcaggatgtgaggtctgaactgtttgtggctctgtgtccagggtgtgaagtctttgagctttatgggagtctctgtctgtaatatgaggtctctgagctctttgcagggggcgtcggggggttctatgtctaggatatgaggtctttgagttgtctggggattttatttttatccagtggatgaggtctctgagatctggggggatactttttcaggatgtgagattttaaaacaggttgggatttttttttctagtgtgtaagctctgagttctttgagcgtctgtatccatggacgtaatatttctgtgctgcttgggggtctgcatcccagggtgtgagatctgtgttcccggggagtttgtatcacagtgtctctgggctcgtggtaggtctgtgttcacatcatgaggtgtctgtatctttaggggtctgtatgctggatttgaggtctcccagctatttggtgtgatctgtgcagaatttgaggtctctgggctctggggtttctgaactcagagtgtgacttctctgagctgtttaggggtctgtgccaatgtgtaagatctattagctatttggactctgttttatgagggtcctgaactggttggctgttttgcagggtgtgaggtctctggctgtttgggaatttgcattctttatgtatatagttttgggtctgtgtctaagatgtgtccgtctgcaggtctctgagctgtttctgtgtctgttctcagactgtcaggtctctgaggtgtctggggagtctgcattcagaatgtgatgcttctgcacactttgagtacctgtgcttgagaaagtcaatctcctgagccatttggaaatctctgtttatgatataagatctctcagttgtgtggccatctttgtccagagtataagatctctgagcaatttgggggtccctgtccaaggtgtgaattgtttcagcagtttgagggtcctcatatcggagtgtgaggtctctaagttgattgtttcatatttaatgtctgtctgttgtttggaggttggtgctcagggatgaggtctctgaactctggagttctgtgttccaaggtatgagtctgaagtatttcaaagtctgttagggctatgaagtctctaaactttttgagggtctgtatttcaagttgtttgaatctgtggtatttggggttttgtattccaggtgtgaggtctctgaactaattaagggtatgggttccaaggtgtaagtcgaaagtactttcagtctgtgtttagggtatgaggccgctgaaatctttgacgacattttccccaaggttttagtctgttgatttggggtccgagttcaggatttggggttttaagtgcttgaatgatctgtggcctaaggtctgaagtaagtgttcagggtgtgtggtttctgaaatctctgagtgtatttcttggggtttgaatatgggaaagctgggtgtctttttcagagtgtgaagtctctgaacttatagagggttgctgacaaggtttggattggaggtatttgagggcctgttttcaggctgtgtggtctctgagcttttaaagggtctttgtcctaaggttttagtgtgaattatttgggcttctgcctaagatgtgaagtccttgaatttttagaaggtgtatgtcccaaggatagagtctaagatgtttggacatgtgtccagtagagttctaagtttgggttaaggtatttggggcctgaattcagggtgtgagatacatgatctttaagggtctgtattccaagttttgagtttgaagcatttggaggtttatgttcagagtgtcaggtctgaactcatggaaggtctgtgttgcaaggtttcagtttaaggcattttgggatctttgatcaggttgtaagttctcaagaatcattgagagtttgcaatccaaggtttgagtctgagacatgtgggtgtctctgttcaggatataaagtctctgaactctttgagggtgtgtgtctcaattttttttttgtctaagtttttggaggactgtgttcacagtgtgaggtctctaaactctctgaggatctgtgtcccaatgttggaatcaggtattcggggtcaatatctaatggtgtgatatctctgaaaacattgaaggtctgtgttttaatgtttaagtctgacatatttggagggtcatattcaagtgtgaggtctctggaactttaggaaattaccaagattttatgagtcagtcatttagtagcagtgtacagggtatgaggtatccgaacttttggagtttctgtatccaaatacttggttctgaggtatttgggggtctgtagtcagggtgtgagatctctgaacttttagagtgtctatgtaccaagcttttattgtgagttatttggagtctgtattcagggcaggaagtctctgaatttttgagggctctgaatttttaaagtctctgtcccaagatttgagtctgatgtttctggggatctgtgttcaggatttggggtctctactatttgagggcctttgttccaatttttcagctcaaagtgtctgggagtccatgtttaaggtgtgttgtgtttgaaggcattaaatctgaggtgtattcgtccgttttcacactgctgataaagacatacccgagactgggaagaaaaagaagtttaatagacttacagttccacatggctgtggaggcctcacaatcatggtggaagtcaaggaggagcaagtcacatcttacatgaatggcggcaggcaaagaaggagagcttgtgcagggaaactcccatttttaaaaccatcagatctcgtaagactcactcaccatcacaagaacagcaagggaaagacccgaccccatgattcaaccatctcccaccaggttcctcccacaacatgttggaattataggagctacaagatgagatttgggtggggacacagaaccaaaccatatcatgagggatctgaggtgaatgttcagggtgtgaagtctctgaattttagagggtctttgttctaacgctttagtgtgaattacttaaggtctgagttggagtttgagctgagtgattttttaaagggtgtctgtcccaagtttgagttggtggtatttgtggtctttgttcagggtatgatgtctctgaactccttgagggtctatttttgcaaggtttgagtctgaggacttgggcgtcagtattctggtcaagaggcctcccaaatttatgagagtctgatgtttgagtctgaggcactgaggatcctctgaactattgaagatctatgtcccaaaggatgagtttggagtatttaggggtctgtgtttagtatgttagttccctgaactcttggaggattttgattttaacgtttgaatctgagatataagaacatgtgtgcagagtggtgtggactatgtactcattgaagtctgtcccccatggcttgaaaccaatgtgttttagggtcaatatttagggtatcaggtctctgaatttttattatgtctgtgtcttaatatttgagtctgaggtatttgcaggttcatattcagagtgcaaggactctgaaatctttgagagtatgagttacaaggtttaagtctgaggtgttgggaggtcaatggtcagactgttttctcatatctttgagggttcatatttgaatgtttgagtctgacatatttggggatctatattcagggtacgcaatttctgaactattggggatctgtgtcccagggtatcagtctatagtatttgagggtcttttcatagtgttaggactttaaacgctgaggaatctgggttttgatgcctgagtctgaggtctgggaatctgtatttagggagtgtggtccttgaactctttgaaggtctgtgtcctgaactttcaacctgagctatctggggatcattgctcagggtgtgaggcctgtagacttttagagtgtgacggaggctttgtgtgccaatttttgggtcagcgttcagggtgtgaggcctctgaactttctagagagtctatatcttaaggttttagtctgaggtgtttggaggtctgtgttcagggcttgcgatctttgaatgctttggcagtttgtgtcccaagattgagttggaggtgtttcagggtctgtgtttagggtttgaggtctctgagttctttgaaggtctgagtcccaaggtttgttcccatttttgtgtctgaagtatgtaggggtccatgttcaaagtgtgttgtatttgaactcattgactgttgcatcgcagggtttaaatctgagcgtcagtgttcagggtgtgaggtctctcaatttttagaagagctttaaccccagttttttagggtcaattatttgggggtctaattttagggtgtgaagtccataatttttaagggtctctgtttcaagcttgggtcatgatttttgtggtgtgttttcacggtgtttgacatttgaattctctgaagttctgtgtctcaactcctaagaccaaggtaaaggggagtctctgtacttggcatgaggtctctttaccctttgagggtctgtttcaaggtttgagtctgaattatttgggtctgtgttcagagtttgagatctttgaactttttagagggccagtgtctcaatatttgagactgaggtatgtgggcccatgttcaggttgtgaggtgtctgagctcattggcgttttgtgtccaagatatgagtcagagctatttggtgacctgtgttcagagtttgagttttgaaagtctgagttccaaagtatgaatctgaggaatttctgtgtctgctcatgagttcactaaactattgagggtctgtgttttaagctttgactctgacatatttggggtgtgtacttgggtgtgaggtccttgaacttttaggtgtgattaaggctttttgtatcaatttttttggtcaatgtttaaggtgtaaggcctctgacttttctagagagtctgtatcttaatgtcttagtctgaggtatttggaggtctgtgttaagggtttaaggtctctgaactctttggtagtttgtgtcccaagaattgagtctaaggtattttggggacctttgtttaagatttgaggtccctgacctctttgagagtctgagtctcaagttgtaccaattggtgtctgttccaatttttgtgtctaaaatatttgggtgttcatattcaggatgtgttttgtttaaattcattgaagttctgtgttccagtgcttgagtctgaagtttgtgggggtcagtttcagaatgttaaggttctctgaatttttataggtctttgttccagagttttagcataaattatgtgttgtctgaattcagggtgtgaagtctgtgtttttcccaattttgggtcagtggcatttgtggtctgtgcttagggtgtgaggtctctgcatgcattgagggtttgtgttccaaggttgaatctaggtacctggtggccagggccggggggtgtctgtattcagtttgtgaggactttaaaatctttgaggggttgtactttgacgtttaagtctgatatatttggggattttcattcagggtatgaggtttctttattattgagcctttgtgtcccatggtatatgtttgtgctgtttgggtttgagttttaggtgttttgagacctgtattcagagcatgaggtctctgaaccccagtcccaggatgtgaagtttctaagctgtttgggattctctaaaccagtgtcgatgacatgttcctgtttgtgggtctggttccagggtatgtggactgggcacttttgtggactctctaaggtaagagttcttggagctattttaggatctgtgtttaaagtgtgaggattctgaacattttttggatcttttttcagaatgttaggtctctgaactctggggaatctcagttaatgtttgagtccaaagtatctggggatatgtgttcagagtgtgaagcttctgaactctttgaaggtgtgtcccaaggtatgagtgtgatgtacttgggctctatgttcaaagtttaatgtctgtgaacttttggagggtctgcatctcaatatttgagtaattttaatttgtgggtctgtgctcagggtgtgaggtctgtgaattctttgagggtctgagtcccaaatctaaggtatttgtgtgtctctgttcatggggtgaatcttgaagtctttgagggtctgtattccaaggttttgagttggaagtgtttggttgtccgtgttgaaagtgtgaggtctctgaattgtttgagcgcctttgtttcaagttttgaatatgagtttcctggtgggttcgggagtggtctgttttcagtctgtgaagtttctaagctttttggtgtctgtgctccaaggtctgagttttaggtgttttgaggcctgtattcagggcatgaggtctctgaactcagcaaggtgtgtgttccaaagtttgagtttgaggtgtttaggggactgcattcatggtgtgagttctctgaactctttgagggtctgtagtctaaatgttcagtttgaggtatttggaggtcttcggtcagggagtgagatctctgaagtctttgagggtctgtttcccacagctcgagtctattgtttttaggaccagtatagagagtacgtcttctctgaactcattcggagtctgtgttcagggtgtgaagtctcttaactcactgagggtctatgttccaaagctgagaatctcttaattcttcaagagcagtgtttcggccaggcacggtggctcatgcctgtaatcccagcactttgggaggccgaggtgggcagatcatgaggtcaggagttcgagaccagcctggccaacatagtgacaccttgtctctactaacaatacaaaaaaaaaaattaactgggtgtggtgacacccatctgtagtcccagctactcgggaggctgaggcagaagaatcacttgaacccaggaggcagaggctgcagtgagccaagatcatgccactgcactccagcctgggtgacagagtgagactctgtctcaaaaaaaaaaaaaaagcagtgtttcaagatttcagtctgagtattagggcctatgttcccatgttttgtccctgataactggggtgagaggggcgtgtgtccttgttccaggatgtaaggatgctgaactgtttagggctttgtgttcagggtgtgaggtctgtgatttgtgcagaggtctctgaggtgtctgtgaatttgtgtttagtgtgagaggttgctgagttcttttggtgtcttcgtgcagagagtgaagtctttatactctttggtcagttacagggtgtgaagtttctgagctctttggggctctctaaatcagtgctgatgaagtattcctgtttgtgggtctggttccagggtgtgtgaactgggcactgttgtggactccctaaggtatgagttcttggagctattttaagatctgtgtttaaagtgtgaggtctctgaaaatttttttgaatctgtgttcctggctttgaaatttttaaactctttggaacactgtgtttcacagtgagaggtctcttagattttgggattctttggccaggttatgaggtatttgttctgcttatgggtctgtgttcagtttatgaggtctttggctaattgtgtgtctgtgtgccaggtagaagaccatttagctttggagttcattgttcagagaatgaactattgggacttttgaaggtctctggacagaatgggggtctgtgccccagggtgtaaagtccatgatctcttttggtgtctgtgtcccagaaggtgaggttttaagcttttttgaggtttttgaggggggttctctgaccatgactttgacaaagtggtccaaggtgtgagatttctaagttaattgtgggtctgtttcccaatgttcaaggtctttcacctgtaaggggatctgtgttcaggttcagaggtctgtaaatctgtttctaggtctttgccctggatattagatctctgaattgtttgtttctttccaagcgtgagatctttcagctttttggaggcttgtgttcaggctgtgatatctgtaagctctgtggggatctgtgtcccaaattttgaggtgtctgaggtcttctgggtctggatttttggtgtgaggtctcagaacaccctttgtcccaaagtgtaaggatgctgaactgtttgggagtttgtgtgcaggttgtgaggtctctgaattctttagttgtccaaatctatggtctgactgtgggtgaggtcttgagctccttgggggcctttctctcagggtgtgagttttttgtgccttatacaactctgtggtctaggatgtaagatctacttactgtttggtggtctgattcctatggtatgagttctgtggcttctaggtggtctgtgttcagggtgtggattccttgagctctttgcagggattgtgtagactctacactgtagaggatttgggaatcaaagctataagggtatattgtcagctctctgaagagtttgatggtctattttccagtacatgttttctatggctctttgaggaagggttctgtgccccagaatgtgaggtatctgaacttttggtgagtctgtttagcgtgtgagtcttgtgagccttttggaggtctgttccaagggcatgaggtttttgagttctttggtgttctgtttacaagatatgagctctctgagctgttcacatgtctgtcaagactgtgagttgtctgagttgcttggaagaagtggtccaaggtgtgggctctctaaggtctttggggctctgtgcccagggttttaagtctctgacctagttaagggtctttgcctaggcttgaaggtcactcaactcttcggacatccattctcaaggtagtgaagtctatggatatttaggggtctagatcctcagtgtaaaatgacttaactctaagggtgtgtttgtccctgatgtgaggtctctgatctagctgagtatgtgcgatccagggtattttagcaagatgtttgaggatctgtgccagagtgtgaagactctgctgttcagaactgtctgttctggatgtgaagtttatgagctgtgtaggggtctgtgtccttctaggatttgggctctgttacttgtagatctgtatccatagtgtgaggcctttgggggtctctttccacagtgtaaagtctcttcgctgcttcaggatttttgtcccggggtgtcaggtctatgaactctttggggtctgaatctagtcctttggcttcagcccctccaggggttcatctctagagtgcataaaggtgggcagggagtaggcaggggtggggatgaggagtgagggatggaacaggcctctcccaggagcggtgatggaacagcccactttgggaagttccaatgagtaggggccacccatttcaagataaattatcatgtgtgttgggtttggtgcttgggaagacatacaagggccacttcaccttggcagtggatctatgacagcccttggtggacacaaaggttattctgtcttgagtgtcttaagtctccatctcctcctccaagctgcttctacccggcctcatgaaaacacctgtttttggtttgctgtggccatatgctcagtgtcctctagtgctatttcttttaccatccctcctctctgtatctaggctatgggattgtacccagggtcaggcaatcagctttggtatgaggaaggcaggatggaggaactttgtggttcctaattgatctatgaatttccagtgagcagatcctatcccaccttcaggacaaggtgttgtttcgtcctttgataacttgaccagaaacactgttatcacccgctgtgtgattccatcacaagttacttgaagccactgagtccacaaatgcaatgaaaagaaaacgtgaaggtaataatgactatgactccatgtgaagaggatgatgagggcttaatgcaagtcacagatggtgctagctcctattctgaggtatagaaagggagtattcaggatcttactaaggataaggtttttgatgcagtgtgttctctgtacccttccactcccctactcctctgggttactctctgtattaccttttattttacttggttgtaagttgtctgagagatttttagggtcccccactatactttgtcatctttggagtcggtgctaatatcttaaccttgttccaccagtgcaaagtccctgtatggaggtgttttatgttaaattggaggtgagggctggatgcatttgtaaaacctgggttaaatatgactattttaatgtccttttaaggtgaaatgattacaattgacaaatcgaatttgtcaaagttctggcaaaaaaacttggttcaaatttcgtttctaaaaacaattaacttggggagatctggtttactattgcagcagaagtccattatagcccgtctctctggttgactacaactcaaaactctggacaaaatacaaaagcaattacttgaggattctgaaaagtaagctaaagcagttggattgtgggggtgaggcaaaatttacagaagctattgggattagattactggatgtctttattttttatttcatgacgttgaccccagtccaggtagtgcaggtgactaatactctgagagaaacactatcctttggccagaggaaacaggaatagggatccatatgaatcctgcacaagtcttagcctagtccctgagctatgcatgtgtagaacagaccaagaccagtgtagcaaaaactgagggaactgagctgtgatttgaactgccctctctagtttaagactaacatctgaactatacatgtacagagcagacacaaaccaaagtagcaaaagcttagagagttgaactgagattagaaccaccactcatatgggaacagatagaagttcagttatgactctaactgggttgatttcctgctaaaactaaaatatcaacattcttcaaaggacccagaatctacagaagaacatattacatataatggccaaggcacaaatcaaaatttgcttgactatagcaaccattttactatgtaaaagcacatcaaaacatcatattgcatactatacatatataaaataaaatagtaacaataataaaaaacaaaaaactaaaaaattacttggaaaaaaaatacagcaaaatgcttccagttctcaagggaaaagactaatgccatccccaagatgacctagttgttggaaatttcagacaaagacttgaaagtagctattttaactgtgttccatgaagtaaaggaaaatatacttgaatttaatgaaagcataggaattctcaacagagaaatagaaattttaacgaagaattacatgaaaatgttagcactgaaaaataaaatatctcaaaaatttcactgtatgggttaaaatagaataatggagcccaggagtggtggctcacacctgtaatcccagcattttggggggctgaggcgggtggatcatgaggtcagaagttcgagaccagcctggccaacatggtgaaaccccgtctctaccaaagatacaaaaaattagctgggtgtggtggcatgtgcctgtaatcccagctacctggaaggctgaggcaggagaatcgcttgaacctgggaggcggaggttgcagtgagccgagatcaagccattgcactccagcctggtgacagggcaagactttgccaaaaatacaataaaataaaataaaaataaaagaagaagaatggagaaaatagaggaaagagtcaatgaacttgaacctagatcaataaaaatgatataatttttagaccagagacattagtttttaaatggacagatcctcagaaaccaataggacaatatcaaaaattttcacattagtgtaattggagttccagaaggagagaaaaaagagatagtaatataaaagacatttaaagatatgatggctgaaaattccccaaatttggtaaaagaccaccacacactcagacacatcataatcaaagtgctgaaaagcaaagatgaagaaaacctgtcttgaaagttgccagagaaaatggcacattacatagaaaggtacaattcaaatggctgcagatttcttatcagaaatcatgaaagccagaggatagtggaatgccatctttgaagtcctgaaagaaaagaacggtcaacccagagatctatttcaagtgaaaatattattcaggaatgaaggtaaaataaagacatactcagatgaaagaaacaacagtcctgctctattaagaaatactaaaggaagttcttcaagttgaagggaaatgatataagaaggaaatgaagatagttggtaatgatggaagagcaacagaaatagtaaataactaggtaaatataattttccctctgaagttttctaaaatacatatgtttgcttaaacaaaaaattataatattgtctgatgagggttttcatagatgtagatgtaatatatctgaccactgtaacatacaggtcactgggagtggaataaagggaactatatgtttgcaatgtttctacatttcacatgaagtggtaggcttctgcttctggccaagatggagtaataggagccagaatcacctttccccagactagcagaactacatgcataaataggtagtctccaacttcagttagaggtttcagtacctctttcaataattgatagaacaagcagacagaaaatcagtgagcatatagaagatttgaacaagactcttaatcaagttgacctattggtatttgtagaacacatcacacaacaaatgcagaatgcattctcatttcaagtgcctatggaacatgcaccaagatattctgagctatataatagatttcaataagtttaaaaggattcaagtcatgcaaagtctattttctgactccagtgaaattagagatcaataacataaagatctctggaaaatctccaaacgttttgaaactaaataactctacgtaacccatggatcaaagggaaattaaaaagtatttgagctaaatggaaatagaagtactgtatatcaagatttgtgggatgccattaaaggcatacttggaggagtatttattacatcaaactcccgtattagaaaagaagaaattcatagctaagaaagttgtagactatagttaataacaatatattgtatatttgaaaatttctaagagagtagattttaaatattctcatcacaaagatagataagtatgtgaggtaatatatgtattaattatcttgatttagctattccataatgtatacagttatcaaaacatcatgttgtataccataaatatatataaatgctatttgtcaattaagaaatggaaaagaaggctgggcgcggtggctcacgcctgtaatcccagcactttgagaggccgaggcaggaggatcacgaggtcaggagatcgagaccatcctggctaacacggtgaaaccccgtctctactaaaaatacatttaaaaaaattagccgggcgtggtggtgggcacctgtagtcccagctactcgggaggctgaggcaggagaatggcgtgaacccgggaggcagagcttgcagtgagccaagatcacgccactgcactccagcctgggcaacagagcaagactccgtctcaaaaaaaaaaaaaaaaaaaaaagaaatggaaaagaaaacaaacaaaaaaaggaaaaaagaagaaagcttgcaaagcaatgaccttagctttcatcttgagaaactagaaaaataatagcaaattaaactcaaagcaagtacatcaagtggtatgatataaattcaaactagacactgtgaaaggttagatgtgtatattataattctaataatgagacaaaaaagacaacagataaattaaaaggaagaccaaatatattcaaataattcaaaagaaggcaggaaatggggaaaaagaacagataaataagcaaataaaagccagaaggaataaacagaacaagtcccttcccaataacctcagagccaaaatacaaccctgccaactattacattaaatgttaacagtataaacaattcaattaaaatgcagagatacatagagtaaataaaaagccaggccctactaaatactacacataaaagacatactttaaatataaagagacagagagtttcaaaagtaaatggatagaaaagttatactatacacaggaaaaaatatgagaagactggagtgggttttataaatcagacaaaatagacttgaagacagtattatcacaaatgaaagggaaatgtcataatcataaagatgacagtaccttagaaatatgtaacaattataaatggtatacacctaatgatagagtctcaatgcacataaagtaaaaatagacagaactgtaatagattttaacaacacttcttacttgatagaataacaagaccaaaaaaattgtagaaggcatagaaggtttgaagatcactatcaagcaccttgacctaattgacatctatagaatacttcatgcaacaattacagaatataaagtcttttcaagagcacatgatacatttcaccacaatagatcagaggctgaaccttaaaatatacctcaataaattttaaagagtcaaggtcatacagagtacattctatggttattagattagaaatcaattataatctgatatattggaaatctccaaatatctgaaaattaaacaacacacttttaaatgattcatgggtcaaaaatgaaatcacaagggaaattagaaaatgttttgagctgaatgataaagtagaacagatcaaaattcaggggattgaactacagagatgcttagagggaaatttatagctttaaatggtaatattagaaaagaagtacataaaatcaattatctaaggtttccccttaagaagctaaacaaaaaagtacaaagttaacccttggtaacaagaaggaaggaaaaataatgataataataggactcaacattataggaaacagataatagagaaaattaacaaatccaaagcagatctttgaaaagatcaacaaacttgacaaacctctaattaaactaaagaagaaaactaaagagaggaaacaaatcactaatattaggaacatacatgagattttcaccagggaccctgcagacattcaaaggataataagaaaaatagtaaacaactttcagccaacaaatttgacaacatagatatgtcaagtggggaaagaagtcaaactttgattcagaccaaatttctgcatggtcacctccttgggaagctcttgaatggcccatcagttattctgagttgggtctagatgactgtgcctttatacccctatgttgatcagtcattaaatgggggctatccagggaaggagtgtgatctttagtgaagcatctgcctacagttgagacagtccttgaaggggctgacagctgtctgataatagcacacccagcaactgaggtaataagcccttcattggagggggactgggtagttaattaatgtccaccacgggtccttataggaacacttgaaagcagttcaacactgtcagtgacaatgcagggcaccttgagatggagagaattaaaggcatgatgtcttattaaagtaatgggtccgggcacggtagctcacgcctgtaatcctagcactttgagaggcggaggtgggcggattgcctgagctcaggagttcgagaccaggctgggcaacacggtgaaaccctgtctctactaaaatacaaaaaattagccaggcatggtggcatgcgcctgtagttccagctactcaggaggctgaggcagcagaattgcttgaacctgggaggcagaggttgcagcgagctgaggatcatgccactgcactccagcctgggagacagagcaagactccgtctccaaaaaataataaataaataaataaataaacaaataaataaaattaattaattaattaaataatggataaaaacataacagcagtaatatctatcacctactatgagtcaggcattgtggtagggaacagagatactgagagaagaagagataatctttgccctcagtgggaagaggcacaacagatagtgtgaaactaaatctcacaaaaaaattcatgttataataatgccataggagtgaagatgggcgaataagaggtaagtgtggtgagtgggctggatttccagaaaggttttaggtaacattttagcatctacaagactaagggagttttgtacaggatgtggcatttgaggtgttctttaaacatagtcctgatttttaatgcgcttggaattggaatattatttggtttagaaaaatatgatgtacacaagagttcttcctctaaaacaactgcttatggaggacacacctgtattactataaacaatatatttttctgagaaatacttttcctgtcaattatgtgctgcattttaaaaacaaccgttatgctgtcttcaggacaaacatttcttttccctctgaaaatataatggaatctatagcaagcaaaagcaagatttatttagggcatttaaatttacagacatcattttggaaatgtgcttatgatttttaaaaatcccctctaccacttggctattcatttacaggacccatcaataggaaatggtacttcattcagtcacctcagatttaaatcttggaatacagaaccccaaataattcaaagacctcataccctgaacacaaccccaaaacctcacacttaaccttggaataaaggcccttagagatttcaaagacatcacactttaaacacaaaccaacaaatagcaaagtctctaccttaaaacatagacactcaatgagtttggaggcctcataccctgacatgaactccccaaatatctcagattaaaaacctgggacacagacactcaactatacctcacacactaaacttaagactccaaagaccttagacccaaacttggaacaaagatcatgaaagagttgagataccttgcacactaaatacagacactcaagtacctcgtacccaaacctcagaacacagaatctcaaagacttcagagaccacacaacctgaatacaaaccccaaacacctcagactcaaatcttggggtacaaatcttctaaatgttcagagacttcaccctgaacagagtcttaaaatgccttatattcaaaccttggaaagcgctctaaatgagttcagaaacctcattccctaaaaacagacccgtgattacctcagaatcaggaaatctttggaaaacagagcccccaaagagttaagagacctcacaccaacacagaccccccaaaacctcagaatcaaatctttttacatagtttctgagagttcagagactttatgcactgaaaacacatcatcaaatatctcagaatcacaccttgtgacagaccttcaaagagttcagattccacaagccattaactcagaccctgagttacacagaattaaaaccttgggacatgacaaagatgttcaaagaattcagagacctcacaccttgaacagacacctaaatatctcagagtcaagccttgagattcagacccccacagatttcagagaccttctaacttgaatatagacccctgaatacctcagactaaaattttggaacacagactctcaaagatttcagagacctaatatcctgaaagcagacaaagcagactcaacaaatacctcagactcaaacctgggatacagacccactaaaatttcagagactaacaccctgaacacagtccctgaatatctcagactcaaatctttaaaagggctctaaataagttcataaacctcactttatgaacacagaccactaattacctcagactcaaaccttgacgcacaatgccaaagagttcaggggccttacaccatgaacattgacccccgaaatctcagctccaaagcttaggatacataccctcaaagaattcagagagctcccaacctgaacacaggcaacaaatatctgagtttcagatcttagaaaacagacactcaaaaattttctgggaccttaaacacagatgccctaaacattacatatggaaatcttcaacccagaccctcaaaaagtcagagaccacaaactccggccagagtactccaaatacttaagacttaaaacttggtacacagaccctcaaaagttcagagacaacacatcctggactcagatccccaaagcctcagattcaaaccatgtggatatgtatccacaaagaattcaggggcttcacattctgaacacagaccacctataccggagatcaaaaacttgaaaaaaagacctcaaaggattttcagagacttcatctcttgaacatagactgcccaacacctgagactcaaatcttgaaacacagaccctcagaaagttcagagaactcacatcctaaccagagtatgccaaatacttaagtctcaaaatttggcacacagaccctgaaagagtccggacacctcacacaccttgaacacagactcccaaacacctaaggctaaaatgtaaaaaaaaaaaaccacacagacttgcaaagatttcaaggccctcacatcctgaatatgaacccccaaatatctaatactcaaactttggggcatagaacatttaaaagttcagagacttcacaccttaaactcagtttctaatacctcaggctcaaatcttggaagaggcctatatgagttcagaaaccttactccctgaaaactccccaaaaaccttgtgatacagacctttaaagaattcagacactttataccctgaaaacaagtcacctcagactcaaatcttgggagagaacctcaaagatctgagaagtcataccctgaaaagagatccccaggtaccactctgtgaacacagtcctgcaaatatctcagatttgaattctggaacacaggccctcaaagaagtcagtgccttcacatcctaaatataaatccccaaataccacaaactcaaatcttggaacacagaatctccaagagtactgagtctctgagatctcacaccttgaagagagacattagaacctcagaacaaaacttaggacaaaaaccttaaaagagttcagacccaaacacctcagattcaaaccttgtaacaaagaccctcaatgacttcagagaccaaaaccctacagaaagtcccacaatacagaaacttggaattttatgtcacaggctcccaaaatccaaggacttcacactctaaacacagaagaacaaatacctcagactcaatcctatgaaaaaaatactgtcaaaaagatctcacactttgaatggagatcccaaaatgattcagatttaaacactggaacacaattagttcagagacctttcattccctgctcagaggaatgaaacacttctgattctcaagttggaacagaagtcttcaaagatttaatgatttacacccagaacataaatacccaaataccaccgaatatgggaaaaacaaacttttttctcctattatactctcacatcactcaatacttcacttctgataccagatacatgggaatttttgcacacatcaattctccagtagactccagctggatatcccacaatttaactcaattctgacagtatctacctggagttagaatcagatcgcataggttacgggctcagtcccccaagactgccctccatttcaggacccaattgcaagtccagaccttcagtagttctgactgatataaattgtctcccacggccccctccttgggttcaatcatttgctagaatggctgacaaaatccagagaaatgctttcttacatttactggtttattataaaggatattacaaagtatagagatggagagatgaagagatgtatagggcaatgtaagtgggaaggggcatggagcttccatgccctctcctggtgcaccaacctttaggcacctgcatgagttcaacaactctgaagctctctaaaccctgcccttttgtgtttctatggaggcttcatcagttaaatcactcaatcttttaaataaaactttttattggaatttcatttggaaaatatttatctttgtacagacttacacttatgttccttttttttttttttttttgagacggaatctcactctgttgtccaggctggagtgcggtggcctgatctcggttcactgcaaaatccgcctcttgggttcaagtgattctcctgcgttagcctcccgagtagctggaattacaggtgcctaccaccacacccagctaatttttgtatatttagtagagacggggtctcaccatgttggccaggctggtcttgaactcctgacctcaagtgatctgcctaactcggccttccaaaatgctgggattacaggcatgagccactgcacccagccagatttacgctcattttccttctattacaatccaaatcatttcttttcaccttttattttaggttcaggggtacatgtacaggtttgttatataggtaaattgcatgtcatgggagtttggtgtacattattttaccagccaagtaataagcatagtactcaatagttttttgatcctcaccctcctcccatcttccaccctcaagtagtcctgggtgtctgttgttctcctctttgtgtccatatgtactcagtgtttagcttccacttataagtgagaacatgcagtatttggttttctgttcctgtgttaattaacttagaataatggcttcccactccatccatgttgctgcaaaggacatgatcttattctttttaatggctgtgtagtattccatggtgtatatgcaccacattttctttatccagtctaccattgatagaatttaggttgattccatgtctttgttattgtgactactgctgcaatgaacatacatgtgcatgtgtctttatagctgaatgatttatattcctttgggtatatgccccaaaatgggattgctgggtcgaatggtaattctgctttgagttctttgagaaatcgccaaactgctttccacaatggctgaactaatttacatatccagcaacagtgtataagcatttccttttttctgcaacctcaccagcagctgttatttttgacttttaaataattaattattattatttatataattatataatttatataattaattatatattttatataattatataaattataactatataattaattataactatataattaattataattataagtaattataactatataatttatatgattaattatataattacataaattatataatcatatttatataattaattatataattacataaattatataatcatatttatataattaattatataattacataaattatataattacatattaattatataaatataattataattattaaatattcgttattataattaataattaatatttaataattataattatataataaatatgatataataatattataagtaatatattaattaatataattatattaagataaataattatatcatataagtatattaagataaataattatataaatatattaagataaataattatattatatatattaagataaataattatatgatataattatattaagataaataattatatgatataattaattaagataaataattatatgatataattatattaagataaataattatatgatataagtatattaagataaataattatatgatataattatattaagataaacaattatattatattattatataatataaataattatattatattattatataatataaataattatattatgtaattaatataagatattaatataattaatatactataatacatataattaataattaatctcacacccattctgattggtgtgagatggtaactcattgtggttttgatttgcatttctctaatgattagttgatgttgaacattttttcatatgcttgttggacaggatctctcaacttttagcccttctcccctccaaggtcagtggtggggctgaaagttccaaccctctaatcattgcccctggcaaccagcccccatcctgaggctatctaggagcccatagccaccaatcaatccattagcatgccaaagacacatcactttggagatcccaatggttttgggaggggtagagaacaaatatatacttcttactacatgacaaacacacataaatcttggaacactgactctcaaaagttcagagacctcacacaatgaatttagatgacaacaacaacaacaacaaaaatcccagaagcaaacttaggaaacaaatcctcaaagaggtcagataccttcaaccttgaaaagagactccaaacacctcacactccaaacttggaacacataccatgtgagtgttctgcctcatcacaacctgaacacctaaatattgaatgacaacatcacaacgtgagtattgaatactagtgattcaatatttggaacctagaccctcacctaatgaattcatagacctcaacccagtacattagcttacagacaaatgagactcaaacctcatgacacaaaacctgaaagatttcagatatcacatatcctgaaggagactccaaacatttcaacagcaaccttggaccacagaccttcaatgagttcagagaatttatgccttttaaaaataacccatatatgtcatataaacattaaaacacagaccctaaaatatttgtgagtgcttacactcagaaaacagatataaaatgccttagtctcaagtcttggaacatagaccctcaaagatgtcacagaactaaaactctaaacacagatgtgcaaatacctacctcaaattcattatataggacacagaccctcagagacctcagagatctcacactccaaatgcagatgtgcatataactcaaactcaattatatagtatataattatatacaaatatgaaaataaatatttattatttaatataattatatataatattatatatgtatttaatatatctcaaatatttaatatattatattaatttaatatattatatattaaataaatgtgtgtatatattatatatattttatatataatatatataatatatatataatatatatatatatatatatatataaaaccttcaaagaaccagatacctcataccctaattatataccaccaaatgcctaagaccctgtgggggagtagtaatataatccccaacaggttcttagttggaatggacccctgttacaaaagacagattaacaagagaaaaaacaaacagaaggttttttaacacgtatatttcatatatacatggggaacacccagataattagtagttcttaaagagatggctttgaattacagcttatatagccttattaacaaagaacagtaacttttcagataagtcacaagacaaaggaaaaggatcttgagtatctataggcagcaagttggggaaagacaaacaaatggcagataaaggtgagttagcaaaacttgccaatataaattcctctggaaccatctccaggctgatgaaagtctaaagctgtcttcatttgttaaccttcactcttcctggttgtagggaggggagcaggatacctttgttattataaattatgtccagtttttagacaaatagaggaagggcagaaagctctcctgtgcctattttctcttaattgtgttcagctcaacaatccttatttgggggaggcatattatggtctcccacaatcccgacccatcaatctcaaagagtcagaaccctcacaccctgaataaagacccccagaagctcagattcagaatttgtaccaaagatcctcagtgatttcagagccctcacaccctaaacatagatccgtaaaaacatcaactaaaacttcaggacacagaccctcaaaaagttcagagactatcacatcctaaacatagagtcccaaacacctcagactcaaactctgggacatggagtctcaaaaaaaaatcaagaacctcactcccaggagttaaattaatgcaggagaaaacaggtcacagatgctcaaagactttgtatcttgaacatttgccctaaataccgtaggaaaaaacttgaaaaataggccctcaacgagttcagagacctctcattccaaactccaatactgaaatgcctcaaactcaaacaatgaaagataaaccctcaatgataatcatagccttcaaacactgaatgcggaacccccaaatccctcagattcagtcttggaatgcagatagagaaaacatgaaagcacagatactgagttctgagtacttacaatctaaatactgatcccaaatgcctgagcttcaaacttcaaacacagaccttcaaagagaactcacaccctgaacaactatctgcaaatacatcaatctctacccttagtacacagaccgtcatagagttcaaaggccttacattttaaacccagactccagtacctccgactcaatcttatttttaaaaagtacttcaacaagtcaggcctcatatgctgaactcagactccgaaatatctcaggattagtacttggaaaacagatcccctaaaattatagatatctcacagcctaaacactggcccaatactgtatcttagactgaaactttggaacacagacactataagatttcagagacttcacaccctcaacacaaatctcctaataccacaaactccacacttggaaaaaaaaccctcaaagtgttcaagacttcacactctggttgctgacttccaaacaatgtagactaaaagcttgaagtacagacacttaatgattttagagacctaacatacaatccagatcccttgttatgtcagaaagagacctgggaatgcacatcatcaaagcactttagaatctccaacctggaactcacatcctcatagaacacaagcaaatcttggtactaatacccttaaagcactgagagacctcacactcagatcatggaccccaaaatatttcaggctgaaacaatggagcacagacagttaataagtttggacaccaggccgggcatggtggcttatcccagcactttaggaggccaagggtaggaggatcgctggagcccaggagttcgagaccagaccaggcaacatagtgagatcctgtctctacagaaaaaaaaaattagctgggcatggtggtgcatgcctgtagtcccagctactctgggggctgaggagggaggattgcttgagcctgagagtctgaggctgcagtgagccatgatcatgccactgcactccagcctggccaacagagcaagaccctgtctcaaaaaacaaaacaaaacaaaaacaaaacaaacaaacaaaaaaaaaaccaaacaaacttcggacacctctcactccctgatcacagacccctcagaactcctgattcaaaccttggaacacagaccctcaaataatttagagagcttatgctctgaacatagactcagaaactattcagagacctcacaccctgaacactgatccccacatacctcagattcaaacctagggatgcaggcctcaaaaacttcagagagcatgcacacataacacagacctccaaacacctcacactcaaacttgagagactaaaaatttgagactcctctccctgaacccagacttccaaatatctcagatttaaacctttatctgccagagacccccaagtaccttatattcataccttacaacacagacccttaaagctttcagagacctttctctgcaaacacagacctccagatacctcagattcaaacctttaaatgcagattctcgaagagatcacagacatcacaccctgaacagaaatgtctaaacaacttagacaaaaaacttggaacccagatctttttttttaaaattattatactttaagttttagggtacatgtgcacaatgtgcaggttagttacatatgtatacatgtgccatgctggtgcgctgcacccattaactcgtcatctagcattaggtatatctcccaatgctatccctcccccctcccctgaccccacaacaggccccagagtgtgatgttccccttcctgtgtccatgtgttctcattgttcaattcccacctatgagtgagaatatgcggtgtttggttttctgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcaggtgtctttatagcagcatgatttatagtcctttgggtatatacccagtaatgggatggctgggtcaaatggtatttctagttctagatccctgagaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggacagtgatggtgagcattttttcatgtgttttttggctgcataaatgtcttcttttgagaagtgtctgttcatgtactttgcccactttttgaaggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaaagttcatatggaaccaaaaaagagcccgcatcgccaagtcaatcgtaagtcaaaagaacaaagctggaggcatcacactacctgacttcaaactatactacaaggctacagtaaccaaaacagcatggtactggtaccaaaacagagatatagatcaatggaacagaacagagccctcaggaataacgttgcatatctacaactatctgatctttgacaaacctgagaaaaacaagcaatggggaaaggatcccctatttaataaatggtgctgggaaaactggctagccatatgtagaaagctgaaactggatcccttccttacaccttatacaataatcaattcaagatggattaaagacttaaacgttagacctaaaaccataaaaaccctagaagaaaacctaggctttaccattcaggacataggcatgggcaaggacttcatgtctaaaacaccaaaagcaatggcaacaaaagccaaaattgacaaatgggaacccagatcttaaaagatttcaaggatctaattctttgaatgcagagcaaaaataggtccaaaacttgggaacaaagcctaaaatttcaaagactttgcatgttgatcacagacccccagttacctccaattcaaaccttacaatgcaaatactgaaaaatttcagagaccttacactctgaacacagaatcaccagttaccttagacttttgtactgaccatgaaatatttcagagaacataagtacacacacctaagtatctcagactcaaaatgtggaacatactccctaatagatatcagcgacctcacaccctgagcatggatttccaaacaccgcaagtaaaaaacttggaacaaagaccttcaaagaatccacagacctcacttcttgaacacagacagatcccaaatgttatacctgagacccaaatgtggacttagacccaccaaaagttcaaagaccgtatgtcctgaatccaggcttcctaatccctaagactaaaatcttggaacagaaactgaaaatttcaaagcctttcgagctctgaatatggacccctagataactcaggctgaatctttgggaaacagatcctctaaaagtacagagacctcgcaccatgaattcggacctccaaatatgtgaaacaaacatttggaaacagacccccatagattgcagggacatctcaccctgaacagagacccccaaatacctcagactcaaacattaaaacaaagatacctggccgggcacggtggctcacgctctgggaggccgaggtgggtggatcacaaggtcaggagattgagaccatcctggctaacatggtgaaaccccgtctctactaaaaatacaaaaagttagccgggcatggtggcaggcgcctgtagtcccagctactcgggaggctgaggcaggagaatggcgtgaacgtgggaggcagaggttgcagtgagccgagatcgtgccactgcactccagcctgggtgacagtgtgagactccgtctcaaaataaacaaacaaacaaaaacaaaataaaacaaaacaaaaaagataccaaaagatttgagaggcctcacatcctcaacatagacccacgatgactgtggactaaaaccttacaacaccagtcctcaaagacttcaaagacctcacacttgtgaacacagatcaccaaatactatagctcagagtccaaaccttgagtcacagaccttaaagagttcagagaactcacaccctgaacacagacctccaaaccattcagaatcaaacctcagaacacagactctcaagatttcagagacctcacaccctaaacacagataaagtattcagaggcctcatactctcaacgctcatcctgcataactcagattcaaacctagggactcacaaatggtaaatatttgggtaaatataatagacgattcttctcctgaattctttaaaatatgcttcatgcttaaaagtaaaatgtataacattgtctgatggggttttcaatgtatgcagatgtaatacataagacaactagagcttgaacaagggatgataaagaggcctataaggtggcaaggtttctacattccaattaaaattacaaaacattgagtctaagtagaatgtggagagttaagtgtgtatctccctctctgtaagggagataggagaaatgcaccagggtagagtttggcagcagtcattcctagagtaactactaaaaaactacagttggccctccatatttgcaggttctgcattctcgaattgtaccaactgaggataaaaaatattcagaaaaaaaattaaaaatgataaaaataatacaaataaaaacaatacagtatgacaactagttacatagcatttacactgtatcaggtattacaagtaagctagagatgatttaatgtatacaggagaatgtgtgtaggttgtatgcaaatactatgccattttatatcggggatttgagcatctatggattttggtatctacaagggtcctggaaccaatcctccatggatactgagggacgactgtgtatgcaaggatatagtaaaaaccacaacagatatattaaaatgtaatactgaaagttttaaataacccaaaacaagggaggaaaggtaaaacagaggaatgaaaaactgacagaacaaactgaaaacgaattataaaatggtaggtctaaatacaactatatcaataataaatttaaatgatctaaacacaccaattaaaagaaattgtcaaaatgaattaaaaaccatgacctaactatatgctgtctgcaaatacaacgatataggtaggataaaagtaaaaagatggctggtttcagtgtagagatacagatggctggaaagggcatcacttccatcctcacaacaagaaaaatgctgggcaaacttcaaattaaatacttttcttgaaatcatcaaggaaataagttttctgggaaaacaactaacctgaaatctagaaagacaaacacctatagggagacacagcacctgagcatttgattatctgagacagatgcctctgaatgccatatatgtcagcaataaaattaaggtagaaacttccaaataacttgctaagggctgagtgtgggctagtgtgagagtgtgaggtcctgggggctgcagacatggtagttttgcacttgcttgcaggttttccctctagcaactccaggaggcactgacagggaaggttgggagaatcctgaaaagactaaggaagggtgacagaagtcattgttgaaactccactctgcccaatcttctcaatgccccacataaaacaaaagttttaattcacaggctgaagaaaacctattgcttgaggtcactggtgcaaccccacagcagttgggagaaaatatggaagtcaccattgaaactctgcccagacccaccttccttagtttctatagtgtgatcagtgcctgcagcttaagcctttatttctgtaagggagataggaaaaatgcaccaaagtggagtttggcagcagctgctcttcttgccagcaccatgggggaactttctctggattctctgtgtaagcctagcggtagtcctaggggagaagcctacaagagggtaacctcacatgaataagtcttttgggagcttcacattctcatgctagctcacactaggttctcaggacttcatcaaaatttattgtttaatctacacactggttcctgcccccttgtaagcgtaaggcacagagtcctgtgtctccctgcaggtgcctgtctctctccagattttggtatagcatttaccctatgaccttggtcctctgatgagtcaaagaaaagttggccaggtgtggtgcctcacagctgtaattccagcactttgggaggccgaggcaggcggatcacttgaggtcaggagttcgagaccagcctggccaacatggtgaaaccatgtctctacttaaaaaaaaaaaaaaaaaaaaattagccaggcgtggtggtgggtgcctgtaatctcagttactcaggaggcgaggttgcagtgagccaagattgcaccactgcaccctagcctgggtgacatctcaaaaaaaaaaaaaaggaaaaaaaaagaaaaagaaaagtaattaatttacagtttaaccagcttttgtcttggatgggataggagcaaaatttcttcattgctccatctctgaacttttgggtcatatggtatatatatatttaagtttatagaaaattgccaaactgtctttcagagtggctgtacaattttgcactcatgttattaacatatgggagatctagtagttctacatccttacccatgcttgatattgtcagtaacttttctttcagtgagtcaagtaagtgagtaatggtatcttttgcggttttaattttcatttcccaaatggccagtgatgctgtgcatcttttcctttgctaattttccatctgtatattctctttggtttagtgaccatgacatttgccaacttacaaattgggttgtgtgttttcttgttattgagtttagagagttctttaaattttatgaatataaggctttagtcagatagatgatttacaaacatctcccagtctatagttgtcttttttttgaagttagtattttattgttttaaggacattgaagagggctcatgaaaatgtaaacataggtagaattttatcatacacatatgtcctcaaattatagcctaatcctcccttctcttgcataatcagaagccaattaccctagctttgacattttaaagataccttgaacaatgaatcaagtgatttgaagttctaaggtcaaaatgctgggtagcaaaaggcttgaccttgtgaagaaaagattgtatcaattcaacttaatgatcttctatgatagaaaaaccttaatgatcaagagacactaataccatttttattcttcaggcctaagtttggcttctatttctatcttataatcttattaatgattaagttggatggtttaggaatcatactccaaggaacccaggggttctatagagcaggggtcccagcccccaggccataaaccagtacagtcccgtgacctgttaggaactgggctggacagcaggaggtgagtggtgggcaagccagcattaccacctgagctccacctcctgtcacatcactggtggcattagattctgataggagagcaaaccctattgtgaactatgcatgcaagggatctaggttgtgtgcactccttataagaatatagctaacgcatgatgatctgaggtggaacagtttcatctcgaaaccatctctccctactccccagtctgtggaaaaattatctttcacaaaactggtccctggtgccaaaaaggttgaggactggtgctgtagaggattcgcagaggctgcctaagaaattgggagtgcagggatagagatgatgaacctctgacctctcctctctggcttcaagtgcagtagctctaattgtttgattattaggtttggctactttttttgtttaatacccatttttattttgaaatgatttatagaacagttgtaaagataatacagaaacttctcatatacttttcacctagattcacctaatgttaacatctaatataaccacagtacgtttgtcaaaactaagagattaacattggtaatatactactaactaaatgataaactttattcggatttcattaatttttccactaatatccttttaatgttccaggataccacaatgcatttggagaagtttttcttttgattctattaacagttttaagagcacaatgcaaaactatcaaatttttatgaagtctgatttatcaatttttttctttcatgaattgtgcttttggtgtcatgtctaagaattcattgataaactaaaagtctctttttataaaactttcttgaaaacttttatagttttacagtttacatttagatatatgacccattttgtgttaatttttatatatggtatgaggtttaatagtggttaatttttgttgcatatgaccatccaattttcctcataccatttactgaagatactatcctttatctgtagaactgctttggcacctttgtcaaaaaccaactggccatacttgtgtaggccaatctctggatcctattctttttcattgatctatgtgccttgattactgtcactttataataattttaaaaatcagattgttcagtgtccagatcttagtttctaaataccatttcttaatacaaggaagccaaaaacctggagaaatggctgattctagagcaggtgaacttgtcttatcatgcagtgccagcaagtaaacaaaagctaaaaaaccaaaacaaaaaaagatgactgtgatatcaaaagtgtgtaggaaccaatctgaaagaggtcccaatgtctaagctagaaaaatctgagtcacaaaacacatggcaactgtattggaatagaactcaaaaaataaaaaggaatccatgagtccatactgatataaatgaacaatttaataagtaaataaatggagaagagacagatctttcttatggaataattccaaacaataaatgtagaaggaataaatgaaatagaaaatcactattagaacagcacagtaataattgctctaggtaaggtccatggattaatactaaaattagacgcctaaacgttaaggagaaaaaggttatttgcattgcctcaaagtatttcccctcaaatacgcattagttactgtagagattttaacatatatccacaaattcttttatattcttccccgcaggaggtggagcttaactctcttccccttgggtgtgagctggacttagtgatacacttctaatgaatagaataagaaaaggggaaaatagtaattttacagtggagaaacttgacatacatcatcttaatcaagtgatgaaggttaatgtcaccagtaagaattcatgtttacatcacgtaccctctgatatgatgtgatgagaagggtactttacctcaacagtattcttccccaaaatccattatcctagtccaatcatgagactcaattaaactcaaattgaggggcagtctaaaaattacctgcaagcactcttcaaaaccagttaatgagattcctccaactttcttactttttttcaaaattgcgttagccattctaattcatttgcttttccttatagattttcgaatcagcctgtcttatatgtacaagaagttctcctaggattctgattagtattgtgttaaatctatatatcaatttgcctttactatgttgggttttcaaatcacgaacacagcatgtatttccacttatttaggtcctctttgacttttatgatcagtgttttatagttttcagcacacagattctgtacatattttgtgatatttatatctaggcacgtcagtgttttgactgtaaatgttttcttaatttcagtttcaaattctatgttgtttttatttgtttgcttttttttaaattatactttaagttttagggtacatgtgcacaatgtgcaagttagttacatatgtatacatgtgccatgctggtgtgctgcacccagtaactcgtcatttaatattaggtatatctccaaaggctatccctcccccctccccccaccccacaacaggccccgatgtgtgatgttccctttcctgtgtccatgtgttctcattgttcaattcccacctatgaatgagaacatgcggtgtttggttttttgtccttgcgatagtttgctgagaatgatggtttccagcttcatccatgtccctacaaaggacatgaactcatcattttttatggctgcatagtattccatgctgtatatgtgccacacttgacagacgctcactttgtcgcccaggctggagtgcagtgtggcacgatctcagctcattgcaaactctgcttcccaggttcaagcaattctcttgcctcagcctcccaagaagctagaactgcaggtgcgtaccaccatacctggctaatttttgtatttctaatggagatgggggtttcaccaagttggccaggctggtcttggactcctggcctcaagtgatttgcccacctcagccgcctaaagtgctgggattataggcctgagccaccatgcctggccccaattatatgttgttaatatatagaaatccaatcgatttttgtgtgatgaccttgtatattgctgccttgcttaagttacttgttggttctaggaaggttttttttgtagatttcttgggattttctatgtagacaattatgttgtctgcaaatagggtaattttacttcttcctttccaatctgaatgccttatatgtcttttttcttgccttgttatgctggctaagactcccagcatgatgttgaacagatgtagttagaatagaaatctttgtcttgtttctgatctttggaggaaagcattcagtctttcaccatcaaatacaatgttagctgtcggtgttttgcagatctctttacaaattgagaaaatttccttctagttctacttcaccaagagtttttatcatgaatggatgctgtattttgtcaaatacttcttctgcatcaattgatattatcatatgatttttcttctttagactgttaatatcaaatattaaattgattgattattgaatattgaattcgcattgcattcctggaataaacttcctatggttgtgctgtattattcttattgctagattcaatttgctaatattttgttgcggattcttacatttatgttagtgacaatcctaagaaccccaaatatttatgcatctaataacagagtcacaaaatacatgatgagaaatacacgaatctacgattacgtctgagattacaatatttctttctcaataattgatagaacatgttggcagaaaatcagcaaggatacaatagacaataatctgaaagacacaaaccaccaagcctcactcaggaagaaatagataagctgaataactctgtatctgaataaccctttaaagaaattgaaattgtagcttaaaaatgtttccaagaagaaaactccaagcctagatggcatcactgaagtattctaccaaatatttaaggaagaagtaataccaattctatgcaaaatcttccaaaatattgaggaggaaagaatgcttccctactcattctatgaggccagaatttcttaattccaaaattggacaaagatattaatagaaaaggaaaatataaatcaacatccatcataaatatacatgcaaaaattctaaacaatattttaacaaattaaatccagcaatgcattaaaagaataatacatcatgactgaatggaatttatttcaggaatgcaggctggtttaatacttgaaaatgaatcaataaaattcaccttattaacagctaaaaaagaaaaaaaatatgattattttaatagatgcagaatgttgaaaacttttgccctatgatcaggaacaagacagagatttccactttccccacttgtgttcaacattgtagtggaggttctaggtagtgtagtcatggaacgaaagtaagtaaaatgcatgcagattaggaataaagtaaaatcgtctattcacaaataacacaattgtttacgtagaaaacatgatagaatctaattaaaccaatgaaaatctactaaaaccaacaagtgagtttagcaaaattgcaggatacaagctcaatataaagaataagttgtatttctgtctactagcaacaaacaataaaatggaaataaaaacaataccatttacaatatcataaaacatgaaaaacataagggataaacctgacaaaatatatgaaaaatctatacattgaaaactacaaaatatttctgagagaaactaagacctgcataattgaaaaaacacaaaaaaagaaaaaaaaagacctacataaatgaagagatatatcttgttcacgggtctgaagactcaatattgttaagatgtcaattctccccaaattgatctataaatttggtgcattctcaatcaaaattactgaaggttttttggggggtagaaattgacaagctgattccataattcatatggaaatgcaaaagaccaagattagtcaaagtaggatttcaagagttactacaaaactatgtcacagtagtgtgacattggcataaagataaacaaatagattagcacagcacagagagtccaaaaataaactcacacctatacaaacaactgatttttggcaaaggtatacaggtagagacataacaaccagcaaaggccagcatgaccaacgtaccctcactaattacctgtgaagggatacatgcataagaggaggcttgcccaagagaaagaagtccaaagccagatgagctttctagcacaagtgagaggcctgcacaccatcagtgaagactgaagtgacaagcacaactatgaaatggggctcagttggcacagaaaggtgaacctggtggtttctatataaggagactgggaaacaagggcttctccttccgatggtggagctgtcaaggacagaatcttccttcctctccagttgcttcaggtgaactactcggaaatgctgacgctaagtaatagctatctgaatagatatgagcatgtgtgcagcaactgaatgggcatgagtagtatttgaaggagttcacaggtagttggagtaacagtttaaaataacatactttgtcaatccatgtcaagatttccaggaactctcctttgcaatcatgaaaattgcctttatgtttaccagtcagtgtttagaaaaatcatctcacaaaatatttatattcataatatttatattcatgcccttattgtggcatacagtaggtcaaaggacaccagagaaaagatcctcctctgacccacagcctcggtctccagctccagtggcctctgcagtttgcaagcatgcttccaagacttagcacatgatgtttcttctgccagtcctgcattctgcacatgtgggcacctacaccatatcacctctcatggatggtgctcatggggttactaagcttctccttgagctgagggattcaaaggaactactggatccatagggtagcacaaggtgaagaagcatacatgtttatgtttatgattcaggcttaaaccagaatcggaaagatacagatttaattccaggcataacttgccagagggtgtgacattagacaagttgtacatactctcaagcccctatttcttcatgtaggaatttttttcatgaagaaatgtttaaggaagtggactgaaaatggttcatgaggatgtttgctgcagcatgaatgatcatctaaaatgataaatatatggaaacacatgcactaaaatgacaaatagaagataggtttttaatgaatgctggaactccagagttatttcttgattctcctctttctgattttgtggattgtttatgagcatgaattacttgaataacaatgttcaaacgtattatttatcaaaagtgcaaattcaaatagtagtgtggtgtttcctcccatcaaatagcagaaaacagtagaattagtcaatttttagtgattggattatttgtaaggagcagatatcacctgtgacataaaatgaatacaatgaaagtgacatctataatcatcacaatgatacaaacaagggcttgggatcacctacatcgttgatcagagtgcttgctttgcactaatgttgcctgaggatgaggttctctgggaaggctcatggtgctgggcaaatcgggatttctttttcagttcagatctaagctctcacacagaaaggaccttacctgtcctctcactccttcacagcatcctagagaaacttgatcctatgcagagaacacagcagctgccaaccgacaggcaccaaggtcagggaggcagcaggctgcagatagcctttccaagtgataataggaaacacctgagagctaatgaaagcactttacctgaggagaaacaggaggctgagactagagcccacagtttatactgattgcagagtgtgagatctcagtctctcaataaatctttatttaatctacataaagatctgagtagtaggagcagctcctgcttagatataaaaagtggttatccctgattggtgatatcaaggaagaattatatattcttcacacttggctctgtattgactctacatcttatctgtaggagagagggagagaaggagagggagatctggcaattctacttctgccatgggggatctttctaactctcaaagaatgtgcgcttctttaagggtaacctgcagagtctgagaacggtccaggtccaggcatgcacggacagaaaggatatttttcccccaggggtttagcgggggcaggagggggtggacagggatgtgcagggcaagctcctttctgtcttgcaggcacccatctaacttttgcccaaagcagtaacagtgggcttctgtccccctacccccaaccccccacaccttctctgacagcagaggatcagaccacctaggtgatggtgaagctctttgacgtgcaccaggtgcaggagacctatgacccctagcactgccttttatctgctgggttccccttggagaaccatatatctttggagccccagaacatgctggttgcacaagaacaaagcacacttactgtctgagaggaaggctggtggtgtggtagcactattgaacctctcttttcttttgagatcatattgtacatacacagtgctacataactggatgtttcaagttaataacttaaaatgaacagcaccactattacaggaaatattattcagcactggttttggtagtcacccatatttcattttcaagtgtgccataatttacttatatagcaagtccatgaccatgctattataaattaagctgttttggaagtcccatgtatccaaatttttgttcacatggttaaagaaaaaaaacattcagtggtagttgttaaagcacagtaaggaaaaccttatttaggactgtggtgatgggtatagggaccattgcaatgggatcttgcagtgggggagagagattgggctcaatactgaatacagcgcaggccagtgggaatgtatagcgaaggagcagtatggcggtccgtgggtggaaaattactaaaaggaaacatcaggggtaagggggattctggctaaacccacctagcaggattcttgctgaagacaggccaaggggaatcagacatcacctgggggatggtggaagatgaagaaccccatgcgatagcaagtatgatcagatattgaggatggagggttcatgccacattgacttagcagggctctttgctaaaactgggttttacaaggaaatgcacagatgggcctaggaggagaagtttcagaagcctgacttaaaagtttggccaagcaaggaatatttgtcaacattcaagacagtttccttaacattaaagtcctagaagtagaaatgctgggtcacaggattttttattttttgagacagggtcttgctctgttgcccaagctggagtgcagtggtgtgatcttggctcactgcaacctcaacctcctgggctcaagctatcctcccacctcagcctctcaagtagctgggactacaggtgtgcaccaccatgcccagctaatttttgtattttttgtaaagacagggtcttgccatgttgcccaggatggtctcgaactcctgggctcaagaaatccacccacctcagcatcccaaagttctaggattacaggcatgagctgccgcacctggcctggatttttgtgcaaatgtttaggcttatttatgtatgtgggtttatcatccttctcctttacatttttttctggattcctatcatgcttaaaatggctttgcactctctgagaacctaagctttcacgcatctctgggaagactgaataccctcttaagggccactgaggtagcagcactgagaaaaaattaaagggtaaatttgcaggtgaaatgcagagctgggaacattcctagatccagaaggacagaacattttgcaggaggggccagaagccagaaacaagcccttctcagcaccgagcaggcccttcctccaggtggcacagagcctctaggaggcgggagagggctggaaagacaacccacgtgacacacccccgaggtttgggattggctggtggggttgacactgctgaggtctaaacaaggaggcagaagtaggtaggtgccacttctcttcccttcattcttcgccaggctctctgctgactcaagtgtaagtgagaacaggtgtgagtgagtgggccggcgggcttctggtgggtcgggcactgtggtccctggcctcagagaaggaagggcctcgaggtcatcatccttctcctagcaggcagctatgcggcggggcagggacaggggaggaaggagggccatgaaggggaggagggtcagccaagatgctgtgagttttggagcgggacactatctgagtcctggaggcatatgaaactgtccataaaggacggatgctggggtcctcagtgggggccagggaaagggtgggacagcccgcgcttgacagcgcctgcctcagtgctcgtgttcactgggggtcttcccatcagccccttcacccacgaggtgaactgccgcggagctgtgagggtgccgtttgcattccaattgtcgggactctttcacctgagactgagactcagtgggtgggtccaccgatcgttcctccatgggagtttaagtgtgaagaggagctggtgggcttcaggagggtcgggcagcacagtccgtggcctcggaggaggaagggcctcacaggtggtggcgccgccatgaccttgtggttgtggcagggctggggcgagggaggaagttgggccacggaggggagagggatcagatggagcaaaacttggggggtactttttgaggtatctttgagtcccagaggcacctgaaactgccgaaagaggacaggtttcggagttctcagtggggacctggggaggaggggacctggggtggctgtatattaaaaaatctcttcataatggagtttagttatgaaattaagtctctttaggaaagaccccatgttttgatctaggacttgaagatcacttctctgccgagctggctgtggaagaaacaaagcagtttgcagatagatttatttgatgtgattggaaaccaggcgtagttattattaactcaggacctattatggaaatctcacaaaattaaaaaaaattacaatcagcagatggccatggaaagagtcaagtataattactcctttttattgcagtcttcagttcacgatcttctagttgcagcgatgagtgcacgagtgagatcaagatccagaggaagaggagatggtcaggaggctcccgatgtggttgcattcgtggctgtgagtacatttcagtatcttatttccattggcagaaatgtatttttctgaaagaaaatctaaaacattgttaaccaatatagatctgttatataaaggacttccctgctgaaaatagttgcaaactaaatcacattaatgagacattgagcaaggagacttattttctgatattgtctgcatatgtatgtttttaagagtctggaaatagtcttatgactttcctatcatgcttattaataaataatacagcccagagaagatgaaaatgggttccagaattattggtccttgcaggtaactccttaaagtatattctatataggaagaataacttttcttaagagtacttacagagaagataggaaaaacctcttcagatttatttgtgactagctaccttcacatagtatgtatatttgtgacttctattgccatgatattaataacaatattctatttgcatctactctcccccacctctcaaaagcccggtgaatctcagcaagaggaaccaccaactgacaatcaggatattgaacctggacaagagagagaaggaacacctccgatcgaaggtgagaagggcatggaggagcattttgtgtttcatgtatgattttatactagtaacaggaataaataaaccatcccctaaaaattggctggaaacctgtaaagtaatccttggtaagggaatagtgtagttttcagctgctgtagtccttgtgataaattttctcttcagcattttacttatcttatatcttaagagttctttggcatacttggaaaatacaatccttgccaagactctatattagcaaacaaaaggaaactacattaaatttagacaaaattgtaaactgtttcatgagttaaacttggttttattgggatattatttttctgggcataagtcattgcattaaaagtttgagcaaaccatatattatggttagatcttacatagcaatttttagaaaatgtcataattcagagaaataaaaatgtgaaatccttttagttaccgttaaaagtcttcaatacttttgtctttctgaaccataatctgtttgtcatatatttattttttaactttttacttagaaaggacttaaaatgtaaggaaaagttatccaagtacagtgaactcctgtgtattcttcaccttgattcactgattgctataacattttgccatttatctccctgtttttaccatattaatatattattgctgaaccacttgagagtttcaaatatcacaactgtttactctgtaagtaattcagtatgtatctgctaaaaatatggataatctcttaaataacctcagaacagttatcaaattcaggaaaattagcattgagaaaacatctaatatatagtccattgcagttttgtcaattggcctaggaatgtcttttataggatttttttcctgatccaggatctaattcaagactactcattgcatttagttgccatatctctctggtcttctttaatctggaagtgttcctcagtctttctttgcatatcatgacattgacaactagaatccaaaccaattgttttgtgaaatgttctttaatttgggtttgtcttatgttaatatttttacagacatttttttcattcatttactggggcttgctaggtgccgggtaatgtactaagtgctgaggatataaatgagataatgatttctgccttgagctcacaatctaatcagggaaattcatgtaaacaaataactgctgtaatgagtgatttacagtaacagaagtatatgtagattgtgaaagtgacaactaagttgtcttaaacagtcgtaggaaaagaaaacttcatagtagagataatattcttccccattttctagtagaaaattccaatgcccattgcactcatgcatcacatttgttagaatacaagcctacagagctttatttaataacactaatttataatttactgcttacttatatcaataacttttttatttatataagaacgtaaagtagaaggtgattgccaggaaatggatctggaaaagactcggagtgagcgtggagatggctctgatgtaaaagagaagactccacctaatcctaagcatgctaagactaaagaagcaggtacgttattcattcggaatggaagtcatggggttactctttttctataatatactttaataacaagtctcgcatacaaatattatttgaaaggtagttcagacaccaaatacttgattcaaagacagtgtcaggggaaaaatgaattaggtcaaagccatgttgttgaattataaaatatgaaagtattattactttggagtagaaatcttccaaaactcaaggcaagtgatcaaatacttttaaaagtatatacattacttaacataccccaggggcaattgggtatctaaatgacacatagtgttcctttaagaaaaaaatttgctagaattgtttatcacaaatcgcttttaggcactaacaagtaagatagatctgtatgttttgaattttccaagttggtttgttgattttttaaaaaactgtgagctagactgagaaacagtagcagtttccctcacattttaatgtcatctatatggtagtggcttaaataaaccaataagaccatgtatatattttttaacgtgcatatctggcctccaaccatgtaatttttatcatctaaatcaggacacttttgagagggaaagggaatgctatgaatacaacatcaggttaacaggtgccaatgagacaaatggccaccctggtataaagaatccacataaagatttaactagatcaatgaattatttttgcacttttgctcaaagagacaaaccaaatggaatggcattctttgacctctctttagtcagctaaacaattccttagctaatatataattagcagaaagtttttagtcaatacatttgagtgacactgtgtttgcttgcttgttttttgcttcttggactttttgtttgattaaaaaatcaaaacaaaacaaaactgaaatcagtggctgtttttgccctctacttaaaatgatctttaaatgggctcatagcatttaatctgttctggcttgagaagtctttgtttccttgtaccactagagtgaggcattttaaaaattagtacacatatgcctgaaaatgtacattagcatagaagtctatgcagtggttagcgttctggttttaatttcatcttaagaaaccaaaactagtgttctttgtgtgcttttagtgtcatctcagtaaagttctgctaagtaatgaactcaactgttatgtttatattttaggagatgggcagccataagttaaaaagaagacaagctgaagctacacacatggctgatgtcacattgaaaatgtgactgaaaatttgaaaattctctcaataaagtttgagttttctctgaagaagtcatgcgtgtcttttgtaaaatttattcctaggaaattgacactattgtaaatggtatctttaaaaaatccttgtgttctgtttagagctggtatatatttttgtatactgattttgtgttgggcaacattgctaaacttgcctattctgttggtttatccctacgtccttttggattttctccatacacaatcataccacatgtaaataatgataattctgttttttccttttgaggctttgtactttcatttctggtccttatgacactggccagacccctccagtacaatgttgattagaagtgatgatgatgtgaattcttgtcatattcctgatgtcaagagggaaactttcaacatttcactatgataggttttaaaaatatatgtagattccttctataggttgagtatacctaatatgaagtcctccaaaatctgaaactgtttgagtgcctccgtgatgctcaaaggaagtgctcatttcagatttcagattttcagattatggatgtttaaccagtaagtatgatgcaagtattccaaaatctgaaacagcatttcagggatggtatactcaacctgtattagattaaggacttttcaaaaaattcttagttttctaagagtacttaccatgctcaccatgaatatatgttgaattttatcaaacacttggtctgcatctattgaggtgtatgatatttctccattaagctgttaatatagcattcctagaataagcccaatttaatttgtgatatattgtccttttatgtattactggttcgttttcctaatgttttgtttaggatttttgcacttttgttcacgagcttgacctataaatttttaatactcactccattcaggccttggtatcaagggtattctggcttcataatatgagttagaatgtatattcttcttttatttttccatatagttcagctaacattggaattctttcttaaatgtttgatagaatttgccagtgaggatatctggacctggagttctctctgtagggaagtttaaaattgaatcaatatctttagtcacattaggactatttcagttttctatttcttcactttgggttttatttttctaggattttgtccatattatctaaatttttgttatacaaaatagtccataatatcctctctttatcctcttaatgcctgttttcattcatagaactgatcatttgtgtcttctctcttgtattcttgatcaatgtcagggtcttttcaaaataaactaacttttggctatcctatttttgttttacattttgtgaattttggctcccacgtttattcttttactttgtgtttaatttgctgtttttaactccttgagatagctgtttagttcattaattttcagtcttctttttaatgtatacttcataactttctctctaatgagggctttagctgcagtccacaaattatgatatttagtatttttgttattcaactcaatattttctaattcacattatttctttgaacgatagattacttggaagtgtatttcttccaaacatttgaacactttctagctgttgttgtgttacacagtatagataactgacaatatctgtttacaaaagatacatccaaaacataaaaatttacagaagttgaaagtaaaaggatggacaaaagatattctgcacaaaataattaaaataggctttaaggcaaatgagcattactaggaataaaaaggggtatttcacagagaaaaggttcaattcactaggaagatttgattttaaatgtgagcctaatgtggtttcaaaatatgatgggaaaattggcagaataggaaaagaagttggtaactgagagaataagcagacaaaaagcaataaggaggtggggctcttccttactggcaaactaagcacttggctttgtctgcctttaaggtagcctaacactgattcttaccctgaggaggggatgtggagcagacctgctggtgagctcctggtctttcctttaggttgtactcctcccagtccatcaccaggtattggaactgctgtaggtatgcaaggaaatctaatacaacctggacatcatttttactttctacatgtgtcacctggtggcaagagagaggtggcagatagaagggaatggcctcataaactgggtgcgtcatcacagcaaggaactagttttagagattcattgcaagccgcaaagggcagacatttattgaaaggatgctggaatgcttcaagctgactcaggaaggatggggcccagggcgaccctcagttgtatgggaaccacgcttcctcctttcaagggctcctgattcctgaggaccaactcctgctgctaaccctaggaggcctccccatcccctccctggaggaaggggtcaggtggagagctgatgtcccgtgctgagcaaggagaatgttgctagggtatgtatactcaggcagcacagccacacaagccagacagcgtgcactaggctacagccagccaccaccaggactcggggactggactcttcctagaacactctttctcctccgacccatgtcctgatgcctgccctgggctgcactctctgggaccagcagctacagcccgacaccctcgagccatgccccaggtctgagccacttactctgggcacactcttcatgggctttggggtcctgctgcccagtgccagcagccccttggcacaggggttcccagaggcccctcagccccatgtccaaccccttctccccgctggcagctagctccacaggcttctttccacttccacctgctgcccacctggggacgctgccagggcttaagggtcttgggactgtgtcctgtagtttaggccccctctcagctgtaggggaagtgccagctgtagggatggacttgtcatgcctcatccctccagctggccttggagagaagagctggattgtgcccccgggctgctcagcatctgctgggccagaaggctggctgccaagccatcaacccacctatggccttaggagcccagaaggagacaaggagcaagcccagaccctgcagagcgctgataagatgggccagggacatgcctctccaggcccagcagccttgggagccacagccgcttcggagctggggtccaggcctccccagaactgcagctggagcttcatccttttctgggaagggcaggacctggggtgggaggggagactgggatggggctggaggcaggctcggctgcagaaaagatggcctgtcacagcttctgcctgcactcctcaggcaggctccttggaggggacatttcacagcctcagaaacatttctggaattggcacccacttggcccccagctctgtagtggctgggggaagcctgcatggaagaggggaagaataagggaggaagatcagagctgtaaaaggggatacaaagcctgtactctacgaccattgtgtcaggcacaaggtactattccagaagcctttgctgaagtgcaatggatagtaccctggattggggatcaaaagaactgagttggcttttgattctacttctgaaaaactttgtataataacatgtagatgatcctctttgagtcttagctttattgcttgtaaaatgcagataattcctccctcccaaggattctatatagattgagataaaaaaagtgcgaatgtgcaaagtaaacatctaggcctgtcctaaaggcactgtgaacgttggttgcatccaaatctgaattttgtctgggaccagggtcagggaccagaatacaccagagctgagggccagccctacctgagaaccatcaacaaacttaccccacatcccattatacctcctcactccctgcagcctgtcagcttccccaatctcccacactcactgtcacctggggctctggtgcaccagatgacactacttgctccctggtacacaggtgagtgcagccagtgtcatacccaaggcctctaaatgaggtccacaggcaagagccatcccagcccacatctgatatccaagatgcaatgctaagtggaaaaagcactgtagaacagtgtgtggaatatggtcttgtttatgtgtgtgtgtaagatataggtataaaatatacttcaatattcatagaaaatttatggaagaatacacaaaaattgttaacaatggttattactagttctacagggatgataaacagggaggggtgaggactgtatctttactaattatcatcatttgaatatttttgccatgaacatgtgttacttttataatgtaaaagcacttaaaatcaaaagatgtagatagtaaattaatatgtagatatagatagatgatagatggacaatagcggtagataaatgatatgaaaatagctaaaagctaaaccagacagatatatctgtgcattggtttcctcacgtgaaatggtacctatttcataggattattgtgaggattaaatgacttcatacgttcgagtccttggaacagtgcctggcacacagtaagtgctcaataaatgttttctttcggataatactggtgtggagatggtggaggaagacaggctggctcgatgtgataatctctttcgccatcttgtggtcagtggggcacaggccacacagcaacattaatgccaattagcagcatgggttcactttgcacgttttcaatcctcttcataggtaagtgtaggagttcaggccttagggatggaggacctaggacttttaaaatcgaaaaagagcttaaagaaataaacaaataactttacaaatgggtagccagaataggacttagagacccctactctagtcatctttgacaccagatgctcctgatccctagtcctgtcagtgtcaaaaagaaagcaaattggcggtcccctgttttttgttttgttttgttttgttttgttttgttttcaggttcctcttttcctgtcaggcttcttagttgtatcaacagaaccaattttagcttacccagaaaagggatttttgaacacctattgagtagctcagggaaacctcaaaaaggccagagaatctggtttgggagctaggtggccacgagttgcaatcctaccccctctgcggacaggagctactgaggctgagtccagcaccactaggatatctcttacagttgtttgtgaaaactcagtacggctgcttgtgaaaactcagtgtctctctgacactgtcaccaggcatagcttcttctgttcttctgatttccgctggtctcttcacgtgtttctcctgattcaaaatctgaatggggaacatctaattggtggagcctagggctcacacctctcctctaggctgagttctggtttccaccttagggaggaaggactcttttttttttttttttggagacagattcttgctctgtcacccaggctggagtgctggagtgtagtggcacaatctcagctcactgcaacctcctgggaggaaggactcaatgcagggcttctccaaaatttaaaagggctattcagaagagcctgggtaggacaggggatgatgatgctctgactttgggaaaacagcattgagcatgtgtgcttcagagtcccacatcccttctccaggtcctgtctatctagctgtaggttctacatatgacccaggcagtactgggaatctaggtctgtttgactcagtggtcaggccgggtatggttgcacatgcctgtaatcccagctactcgggagactgaggtgggaggatggcttgagtccagtaattcaaagcagcagtgaactataatcatgcaactgcactccggcctgagtgacaaagcaagacctgcctcttaaaaacaaaaaaatggtggtcagactccatattgattattaggggacaggtcatggtgataccagatggaaggatttttttggacagggaagtccatgggggcggtggggcacaggttccatggccgactggtttaccactgtattcaacagcagctagcttggtgcctcaatacatgactgaaagaatggtggaataagagaacaaactaagctggccaccttccttctgtagttgtaaaatttcactgacacttagggcccctaatttcggaagaaacctaagagatgtgttttggaggtgtcttgttagataagggagatcaagaaaggtaactccactcataccaagctacaccttcacgtagggtttctgactcccatccaggaggtgactcccctccacatttagtgtctccactcagaggaaaagaacaatcaagtgtgtgctacaagattctactgtccatccacacattttctttctttctttcttttttgcaacagagtctcactctgtcacccagactggagggcagtggcaggaggctcactgcaacctccgcctcccaggttcaagcgattctcctgccttactctcctgagtagctgggattacaggcatgcagcaccacacccggctaatttttgtctttttagtagaaacggggtttcaccatcttagccaggctggtctttaactcctgacctcaggtaatccaccgaccttggcctcccaaactgctgagattacaggcgtgagccactgcgcccggcccatccagatattttcttgaaacaattctgcacttaggacatatttccaggagaaattgatgaaacattcccatagtggaattgcttgagattgctgggcctcaaggtctattggaatctaacttcaacatccagctgatgggtcagcctgcggcctccatatttccttctatgaatcaatgatggcaagtgcccatctctggccacgccagctgaaaggcacagaccaccagagggagcaggtgtgcctcttccatggtggaacatggcacttcctgtttgccgccccccccaacctgccctgctctggaaaacaccactgttgcttagcaacagggaaggcagtcatccagggccccatgtttctatcagtcaccaacccaagtgagacatggaatgtaaaggcctgccttcagatcacatctactgtagcactttggaacttgctggccactcaaaatgtggcctgtgacccttcaacatttcaggggtccccaagaccacccagacattcagtgaattagctaggactcatgggactcagtatattattgtactcatggctgttattacagcaaaaggttatacaatatgatcagcaagaaatagaaagaacaggtggggtctgcagaagtccacgcacaggcttcctcatgctctctttctcctgtgagggggcccatagagcacatccttccccaagaatgaaaatgcacaatatgtgggtaatgttttgcccagggaagctcacttagtgccccaaatttttactagggtctggtcattaggcaccccctgcctattatgtacccaagttccagactctcggaaggaaagcaggtgttcagaataaactacgttgttggtacaaactggttaggcactgtgaaccacccttctcaattagggaacatgtcaactgctgtcttagttttctattgctgccataacaaatgatcacaaacttagaggcttaaactgtataaatgaatcgtctaacaattctgtaggtcagaagtccagcttaggtctctgggctgaaatcaaggtgttggcaaagttgtgttcctttctagaggctctaggggagaatccatttcctactcattccaggtcggcagaattcagtttcttgacattgtaggacagaggtccctgtttccttaggctgtcatctgagggccattctcagcttctataggccaccacattccttagcttgtagcattttcctccaccttcaaagccagaacagtgagtcgaatccttctcaagtcacatctctctggccacagctgggaaaggttcgccacttttatggtctcctgtgattggattgggtccacccagttaatccaggataatcttcccatcccaaagccccaacccttaatcatgtctacaaaatcctttttgccatgtaaagtaacatattcataggtcccagggattaggacgtggacatccttgcatatccagtattttgcctaccacaagtgccaagttcctagatgccagccaagggtctttctaaatataacagtctcagggatgctatgttaactcttttctgcatactcatgcatatctaaaggaaggtgacatcatgagtgataggggataccctcttccaatatcttgtagcccctttcatgcttaaaatgtcttggacttcataaacaactggacccggggctcagcccacaaagatgccttataacccagattccaatatggcatacacattctgaccttgggactgcgcagtgctatccctttcctgcttcaacctggacaggagccaacgtctaggaaactgttaggttacgttctctcaagcataggacttgacagaaaatatatttcagtttaaattcttagctatgtaccaagagcaagttatttgttctctgtaagtctcatttcctcatctgcttccaggtataacacactgtcttatagatttaaatgacagaatacatacaataaggtatgtgtaaggcagtgctttccagatcacaatggctagtgtgctaggagatggaacatccagtaggaacaaaaacaagactaaagtctcctgtttcaacatggagcttcctctagggggagaaagaagagaagaggcagaggttcacttttaggatctgcctgggtctttttttttcctcctgagctcatcactttattgacaaacttatttctccttcttcctgtgaaggtgtgatattgtgaatgattaacctttgtttttcaccccaagctccagcttgcccttgtactcttggccctgctgcagatgacagacccaaggcttctgccccagggtagagttatttcagcagaaatgcaaatagaatcaaagagcccaagatcagcatttgagtcacagaagagatttcagaaaatgtacactgagaaaatagaactaaacgaaaggctttttgagttggaagatcttaggtcttttgaataccaagacataaggacctggcctatcgacaggcatacaaggatatatggtttgtccaagggacttccagccatctaagactagataaagctcccttacactaaagggagggctgagagggaggcagagagataccgatgacattcaaggccaggggatttcaacctccattttagactatgttgaaatcttaaggagaatcaatctctctctctctctctctctctctctctctcctctcctctcctctcctctctctccctcctctctctctctctctctctctctcctctccctgctcccgactggtttgggttccctttcatttcatctccaaatatcacaatggtattccctggagggcaagaaagacttttagtctgggccttgggattgaggaaatagaagagaatctgtggtgtttacagacactagcaccatccattagggtaggaacagtaagaaagcaaaggtttgtgtcaaagacttgaagttttcctagtgtgggtcttcagaaaaccactttagggcctctgagaaaaaagacactgccatactggcttggtagtgagagtcaggtaaagacctcattcctcccattactggaacagccatgaggtctcctgacagcaaggtgacaatgtccagataacaacaggtgaacaaaatagccctacatacccagagacagagccacttgccttgggcccagctgttcactaagtcatcgggttcttccatttcagtgcaagggtgcctagccaatgtagtgagcaaaggttgatttcaagattgaattttgagggatcaaagttggagcaggtcaaaattattaacaactcggcgatgcccgatcccttctgcctgcagctactaacactgcatggttcctagcttaacaaccctctgaattttggggaagcttcctgtaaacactaaataaaacaaacaatatgtcttgagagcagtgtgtattatggttaaaagcaactgaatattgttcctccagctgggttgcatgaatgcatatcaggggaaccatgagtcccattgaattacaggcaaacgtactatgccaggtgcttttcatgcatttttcaagggagaagagatatagcgtaatcagattctcagaggggtctgagtcttaagccactgttgcaatggggagtcttggatttgtgctttattaactgtgtgtcctgtgaaaattcatagggaacccccatgtcatattttcctgccagtagagtggaaaaaaccaatatcaaccccataacattattgtggggaattaattaaaagatgctttataaataaattcgttttaaatgagacgttcatgtgttcccttccccatcccccaataaatagctctattaaataaaaggcaaccggttgagattttggataacagagatatgtatttttcaaaaatgtatgtgtacacagtttatatatgtggaataatgatgtgtctaatcctgtattttttcaagaatcattttcatagattatttggcatcgtgtgctttaaaataatgatgatgatgataatgataattccttgcacttgcatagccagtagtcctctcatttatctcatcggttgttgacaaagccctcctcttactcttgtaaatgaaatgaggctagtgctgggtctgcagtgtttggttgccatggtttaaattcgtttcataagctgttgcttggcaatcccacgcgtcagctggctctttttcctcagcactctcgccacacgctgtctgaagtataatgagactgaggctgggcaaaggaggatggcagtccccaagcacgttccatcttcccacacaacactgtttgttaccatgatgcttgataaatgtgttaaaagcagagcagtgaagtggttgcaaacatgggatttagtgtcacatagacctgggttcaagttctgggttgggatttggctcagtgtctcctttggccattcacctagaaacccgtctcagtttctccatgtatcaagtgagagattataatatgcagcacctggagtggatgtgagaattggaggaaaaaattcatttaaagtacctgcacacagtaggtgctcagtagctgtaacctgtactaataagggtcatgggagctggtagaactataactttccttgttctgtagtaaaatgctctgatgtagcagtcagtttggacttaatttgtgtagttgtggcccactttcttttatacatagtatgagtgggctcactacaaatccatagagtaaaacagaaatttataaataaactatcaggatcaaggaaaagactgggagtgttgtgactaaaggaagacaagtagagatgctgcagacagaacatatcaatagatgtccactccaggtagtgagtgggtaggcactgtgcattcaaaggggctgtcatgggggaggcttctctcctccctagataaacacatacccatgggcagtggtgtgcaggtaaaacagctctcagggagagaaaagccttgatttgtaacatttgcctatttctgtggtgtaaatactcctaccatgaccaattttaaactaccaatgtgatgccattgaagggagtgtagagttggaaagcaatgcccacaattggctctcgggagcccatcagagcctgcttcagcgcagaagtaatcccttccctaggggaagcttttttgtttttgcttttgttttttttctcttttgtggacatttccaacaagctcttgtatttatagcagtttagggaggtcagttctcaggactgctcttctggcatttgattttccctgattggaagcatatggctgaggaaatagcctctgttctgttgtgcaggcccatcccacatctccataggctgacttcagcaccctttctggcttaagatcaggagcccatgatctttgcaggatccagaggagacttgggagctaggaattacctagatgaaaatcttaattgaggtagtatcttctcccaaagttattttatcttttttatataacccaactcagccatactgccctcgtcatagtctctcatactctcatggtctctcatattcattgtagcattctcagtgctacaatgcatgtgaccttactatgtttatattagccaccaagcagtttcaaaatgaatcactttttaaattcatccatgccactgtaaagctgcttcatctaatatgacttcagtgtagttgtctgattttgatagctggagtaaacaaactgtgcgtgcttgaattccattctggactgaacagtttcaagtgtcagtcagtgatgctcatttgtaagaacaggcacattgaccagctttcagtgaaaatatgttgcatgtgttttacattttacatggtccataatttgtatttcctttccacttcgtatctgacaatgtccagttaaatggctcctacagacagagtgccccaaaacatagtgtctttcttacgaatcagctgaaaaatatcaggatgtttatgaggcagcagaacaggaaattagatataaaacccacaactttctaaggagggtaggccctgttaacaggagatttttttgtgggggcagtggggttagatacaaagtcatgaacctcaatataattaatggcctgtcacagttctgagagttttcagtagtgggtggagtgtacaaatttgaaggtagaagctggaagacacttaaacttcccagcaaaagcaagatccttgagggagagaccaaagtcagggaaaatggaagcctgttagggagatggtgcagggagtgaggggagggggatctgattactggagactgaaaagaaagatttgtgagaaggaataatgtctaatggagactttctagttaaattctgtggggggaaatgctcctaatacatttcccccaggacattttcatttaattctacaatgctcactgtttaatgggcacagattctctatggtgaatgtgagtaaaatcgtgttccaagatttagatatggtagaaaaacaaagcccatgagtcagggtagcagacatgtggcttatatatactctcgtgtgaatgaagggacatctttgcatagaaagatctcatgttcaccattaacttaccaggtaggggtgggggatggagggtattttctgtgcctagctggaggactgtaggttagacaggcttggtgggaggatggaaatggagtttctttaacgagagcctgcaggttcctggaactcctcctcatgctgactgctcagaagtgccccaccaaattctgcccagtggcggcagagtcctgctggggatggtctcgtcagatccagaagagtggcttataagcaagaataagcatacattttctcttaagaaaccagagttaacaattattttattttccattgtcttggtcagcttgggctactgtaacaaattactgtagactgggtggcttaaccaacaaacatttatttctcacagttctggaggctgagaagtccaagatcaaggtgccagcagatcctgtgtctggtgaggggccgcttcctggtttgcagatggctgtcttctcattgtatctcacagggtggagagtagtaaaagctctttggagtcccttttataagggcactaattctattcatgacggctccactcatgtcctaatcacctcccaaagactccaccacctaataccatcatattgggagctaggatttcaacatatgaatttggaaggggggcataaacattcagtccataataccaatgtttttgaaatatttgaaaatgttgtataccaaaaggaagctcagggactttactcttaatattgttttgcctttaagcctttgtgtccatttaaaacttctcaagtcttcttttatatattgaacaaattttcagatcctaaaagagctcatttctaatttatcttcaggaaattttgcctcactgcctttttataaaatccaaaattttgtctccagctatgacttatttggaaactaattttttgaaaaggagtaaggagggttgtggtcataatagattgatggctgcctgctttccatggcatggaattgttgctaggagaagctgcacagccatagatgacagttctcagtgcccgcttcccccgatccagctgacttgtacttgccagtggagtatgagagttactacacggccaataaggggctgtaacccactcttgagggaattaatccattcccgtggaaaacaatccattccctctaggaactaattcagtcttgcaagagtgagaactcacgaagccattcatgaaggatctgcctccatgacccaaacacctcccaccaggccctaccaccccacactgccacgctggggattaaacttcaatgtgagttttggtagggacaaacaaaacacatccaaactatagcagtacctgaaatgccttaatgaggactcctcagaatcagaatacattgttgtgggtagttgtctgaaagaacaccagtcatggtgtttgtagtagagagtattcttataggaagaactttattttgatcagcatgtgtatcagtcaaaattcagttgcacataacagaaattactctagctattttaacgggatatggatttaacacagggagtaaggtgcttacaaaaatcaccagaagggctgaaggagcaacctccaagctcggaaatgactactagaacaacaaaagaactgccacaccaggaagatggctacctctgccacaatcaggaagctgggaaatcaggaactttttttcctgacagctggattcagaatcagaccatgttagcccacatcctgggattggattaaggactctgccatcatagctgttgctctaggaacatgccacctttgctgtgattctgagaaatggagactgtcatcaaatctgttatgccagagctaccccatgcctgctagatccacagcagcaaaatcgaagcctctttcattgccacctctctccccacatgactagatttttaaagataattatcacctgagtaaacctgattagcagaacctaaattacgtctattgccatgtttcagaggagtagctttctagcctgtgtcataaaggaagacacactagagagggcttagaagagatgtttagcaagccaattataggcttcaccacagttattccctgtctagaaagaggccctcatccctgactctgaccttaggagactggcctttcatgatatgaaacagaccctactagataaaagcttcaattctgaaagcaccacaaatagcaatataatgtcactggactgagaaacattatgatgagtaaaacccacattgatgtaagtgatatgcacaatcaaaaaatataacaaggccatatctgtaaagtgaatattagtgtctgaaacagaaactaaaatttgaaaaatcatatttgagaaaaaagtgccttaaaaagttgtaacatcaaggaataccatatatttttaaaggtgccaaaatatctaggacgtatttcaaatgcatttagagtatttgtctgtgttggagagaggagaatgggaatagggattttgggtaaaggaggaaaaataaataaaaaatagaatagcctgtgctgactgatgatgaaagtgtgccatgatctgtgtagtatgaatagctcaactcctaattttgtaatgtctaaataggatacataaaacttaccaaaagttaagtttctgcacagcaaaggcaaccatcaacaaagtgaaaaggcaaactactgaatgggagaaaagatttgcagaccatacatctaataaggggttaatatccaaaatatataaggaactcacacaacacaatagcagaaaaacaaatagcccaattaaaaaagagcaaaggactctaatagacatttctccaaagaagacatacaaatggccagctggtatatgaaaaaatgctcaacatcacgaaccaccagggaaatgcaaatcaaaaccacaatgagacagcacctcacacttgttaggatggctactatttacaaaaaaaagaacaagtgctggtgaagaaattggaacccttgtgtactgctgatgagaatgcaaaatggtacagtgtctttgaaaagcagtatggaggttcctcaaaaaattaaatatagaactaacatatgacccagagaattaaagtcagaatctcaaagacatatctgcactgtcatgtttattgcatcactattcacaatagccaagatgtggaaacaacttaaatgtttatggataaataaatggataaagagaatatggtatatacatacaatgtcttaaattatacattcagtctttaaaaaaaaaaaaaggtaatctgcccacatgtgacaatatggatgaatctgaaccttgtgctaagtgaaataaaccagttacaaaaggacaaatactgcatgattccatttatatgaggtatctaaaatagccaaactcatagaaggagagagtagaatggtggcttccaggggctagggggagaaggaaatggggagttgctcttcaatgggtataaagtttcagtaatgcaagatgaagaagttttagagatctgtacaacattgtgcttataattagcaatgctgtatcgtgcacttaaaaatttgttaagggggtaaatctcatattaagtgttcttaccacaatgaaaaagaaaagtaaatggtgattggaggcatgcattttaaactaatttacaactgaaaatttcacaaaacctgccaaacaggacaggaataatgtacttagattgaaaatataaaaaattaaaatatataaaactcattccccaaattctgaaagacatgcaaatatataatttttataaagcttaaaaatgccacatagggtttaaaatttaatcaaatgtccaaatagaaagtctaggaacattcacattctccactctgatacaaaagtgtatggtatcaaaaagagattcgataaaaaattgtgcaaattaaaagcttattgaatataaaagacatgtacaatgcaaaatcattgaaacatttttgatgattttttaaaaaaatggccagaacagtaagttaaaattgttttaaaatgaactcagtaaacaatgataaaagtataaactgctgtttgggagatatttgttttcagcccatatgaaaactttaaaaactggagacagaataagatcacttgtcttcaaatgaaattgaaataaaaacaaaaatatcaaaagaaccaaaaggagaagactccccaaaacctgaaacaaatctacttgactcataaaagcattgaaaatggaaccccaagtcattcaaatttactgaaagatcatacattatttattagaaacatttcattttataccaatttaaaatttcatagttttgcccaaattgtccaaatgctaccccctaaaatttattattttccaaattcccctgcatcctatttacactaaggccctcacatgattaggcagctgctgagcaggctgggagacatccctttggcacttacaaactgaaacattccacacacataaagatcagctctctcacttttgtttttcacgccatgagatgactttgtcaaaaccgaagctctcaggcctgcccttcccatcatgaaatagcctttgcctacagtagggcctaggagagaacccaacagttcccaaccagacctagagctctcctcctgtgtatccttttctctccctgaattgaaccaggagcttcttccagagcttgtgacagtgcagatcataccgatgtgatttgaagaaaaccctagctgcttccccagccagatggctgctgcagcgggatgacgatggtcaaccttggccttgttcccctttgctacctcctgggggtgactcgaagttcctattgttagttgcaaatgtcttccatgtgcaggctggagtaattaggtggggtatggatggaaaacagaggaggtccctgatataggggttgaagcaggttgaaggggacaaatgcctcaagttgtggggagcagaagtcagggttccagaacagtgaggtgaaagttctaggttgggactgcctcattccaggagtggctggtctgtgggtcctgatctaggtacgagcatcttcaaggtataaagggtagaggtgaaagccatggtgagggctgggctgtaggagggaaaaggtgttcactgaggtctggccagggaccatccccagatactgtatttcatcaaatctaagatgccatcaagtgtgagatgtaccattattttatgtatcaatacattaagtaaaaaggctgccacttaaaccatgccatgatgttttctcagcacttgtaattttttatttttacttgtcaaaagggttctttgagacttatatatagtatctttccatatatcactattgtgagtacataaaaataaaagcaatgtaaattgcttaaaatatttctagaatttcttcacatctagaacctaagtatcccaaatcacttttcagctcagagttcgttgtctgtgttttcccacacagagttggaactatctgtgttttcccacacaacattgtcctccatgccatcaagacggttggtgatgtagcatttcttaaaagagagacccactattgtccatggattttcttccaagttgctgctaaactgcaagttttgatgtggggctttcttgcttggcctgcgagaagttatcctgttgaatgtatctcaataacaaaacccaacagaatttcagctattgtaggtatcttccttgctttagacctaaaacacactttgttgttgctctgcatgaaaatgtggaattgcaacattttctccatctttcagataactattccttcataacaaaccagttacatggatttctgtttccagcctgagggccacaattattctttatgctaatatgcctctgagatttgatctttgctagaaaactctttttcttttaacttttgaaataattatagactcacaagaagttgtgaaaatagtatagggagttctcatggacccaccactcagattcccctaatggtgatatcttaaataactataatgcattttccaaagcaggcaatcaattggcacaatacaatgaactaaattgcagagattactcagattgtaccagttttcatgtgcactctgtattttgtatgtttgtggatcattttatgacattttcctacaagtatagatttgtataaccactacaatcatgatacagaagtgttctgtcaccacaaagatctccctcctgttacccctttacagtcacacttttcattgaggtaactgttctcagcctcctccccctccactcttggctttttctgattgtacatgttaagcagcaccttttgtggcctgcctattttgcctcctaagcatgccatgttctattaatcatctccacaattccctgcacagcaaacccccttggtccttcttctgaccttgccagttattatggtgattgcagcctcctagcttctggcagttaactgctaccacctggcctccattacttcaaggccccatgatccccatggatgttaatgagcccagctccgtgaccacggctcctaccctcagctctagcctgcaggtgagagccgccactgaacttctaagtgatgctggtacccttatcacccatacattccttacggctttggtgaacagtgttttctgggcccctatggaacataaccctctggcaggatttctgacctcacattatgtatccatttcaacatgtccaattccttcagcctctttattccttcctctgctatcctccaggcaacccaggcatttcgactttactcagcatgagcctttgcctacggcaggcttctaagagtcaccctagccatgagtctgccccatcctgatacacttgcctaggtgttaaactcacctcataagaaagtacccttaaactgatgaattctgggttattcaatcttatattctaactgccttgatcaaacacctcaaaatccaatccctggctcatgcctatgtgctggccaatttttccagccccttcagcacataatctctttccttccctatcatgcacaccaaatctccaggtggattatgctggagcttaacccaggtcattatcctggcagctaggagatgagattggggcagctcctgaagggggaaccatttgcttcatggagaagaggcctcactagcatctttcagcacaaggggcgtgctagctcttactggggaaggatgagctagctctgcagtttttgagagttcagggaaatctgcagagccaatatctcagaagtatccatctagatgtctccatcctattttttcaggtttcaggtttttcaaaccaaggctctgactttaccatgacagacttgcctgtgatgagcaattaatcatcttgagaactctgttctctatcaagtcctgagtctgcccctctgatatgtctgctcttctactgaaagagaaaagagcatctttataagctaccaatgagatcctgtggctcttacatttagccattaattgcttattaacagccctcaatttcgttaaccttttgtagggcatcaatacaaattagaactaaccagccaactttgctggcttgttttacaaataccagaatcattgtacctacaaggtgttcacctccaccagacatttccaggtcactactggtgaaatctttagcatttaggtcatcaccttgtagaaaggactatttgttcccatctgcaacttaggtaactttcccatcagcaatttgtccaccaggtggtgagtgatccagtccccaaaccccatctgaccatctgttttattggacttcattaacagtacaattcatgtctgttcagaaccttcaagaaacagatgccaagatgggattagatgtgcaagaaatgtattggaggaaatgcctatgggtgataaagaggaagaagcagaagtaggcaaggagggccttcataatatataatccaggtctgacatctatgaaaggagagaaggaaggaagtaggaaggaattggataggaacagttccagactgctgcacagttcaaagaaagtttgagccaggcatatgaattataggaaacttgtgtcccacaagaatgagccaaaagtagtacttgtaccatgctcagtcagtggctattggtggccctggggaagcatggcctcagtgcaaacatggtggtggaccaagtcaggtggcagctggggctatcagtcaactatgcttcctgcagcaggagatctcagtggcacatttttatggccactgcatgtggcattctaggagaaagcctcacttctgtctgtggttttgatccctggggaaagcattgaaggcttctgcctgtctctctctctctttctttctctctctccctctctctcttttatttgagacagggtctcactctgtagccaggctggagtgcagtggctcaatcagggctcactgcagcctcgaccttccaggctcaaatgatcctcccgcctcagcctctggagtagctgggactacaggcttaagccaccatactcagttaaattttgaaatttttgtagagatggggtttctccatgttgcccaggctgttctcgaactcctgggctcaagcaatcctcctgtgtcgaccccctaaagtgctgggattacaggtgtgagccactccatttcactttaacagcaatgcatgtacaaagtagggctgattgtttcccagtcccacctgtataccgccaggaccagtttccacattaccaagaaaagattccctcatctcccactccccactcaagactgggaacagaaatggcacctagcaatgtgccgtgatgaattctcaatcattttaggatcctcttcagcccaagtagagtcctggcctggactttggactctgtcatatagctaattgatttaaaatgtaaaaccctagactaattgttataactctttgcaaaactgtgttttacccctgactcccactctgggaccccaaatgtattaaggcctccatacacagttgtcattcaggccctaatatatacagatgttgcttcctcaggctcatcaacctgaagggaagggcttttagcccaattacaccttaagacatcacaaccttaggcagttcatttcaaccttaggcagttcatttcaaccttaggcagctcatttcaacctttaggcctgattcattttttttctacaaaattggagatatgagatatctgtgaagtctgctattcaccaggtgtttctgagttgaaagtgccctcacctttccctagcagcgaaatatcttaattgggtggtttctagttgtggggacactctcttcaacttaacaagagtagcttggaattatctccaagaagagccagttctgagaagtatttgacaaagtttacctaaagttatgccccagtaaggggccatctgaaagcatttcttagggaggctggtttgggaccatcacaggaatcattctagccaagtagaaaaccagacttctttcaatgtttacttctctccaccatccaatgtatacaacattatgatttcaggtgcattacaatgtctacagtgtcagattctgttatgagttgaattgtgtccccagaaagatatgttgaactcctaatctccagtacctgtgaatgtgaccttatttggaacagagtctttgcagttaagataagatgaggtcattaggttgggcccttattccaatatgactgatctcttataagaagagacatagggagaatgccatgtgacaacagaagcagactgaagaggtgtgtctacaagcccaggaatgtgaaggactgctagcaataccagaagctaagagaaaggcgtggaacacattctcctctagagccttcagagacagcatggtcctgccaacaccaacttcggacttctagcctccagaagtgagagagaataaatttctgctgtttaagccacccagtttgtggtaatttacaacagccctagaagactaacagattctatactgactggttagttatgactggggtttccagaactgtgaagggaaaagttgggaccaactcatcagagagcagtgtgtgtgatactttggtgttcctggggcttctccaagttctaataaccaggaataaaaatgtagagaagacgattcagcttaggtctctggttgtgaggttttttgttgttgttgttgttggccaggctggtctcgaactcccgacctcaggtgatccacccacctcggccttccaaagtgctgggattacaggcatgagccactgcacccagcctgaaaaattgtttttttaatttattttattttattattattatactttaagttttagggtacatgtgcacaacgtgcaggtttgttacatatgtatacatgtgccatgctggtgtgctgcacccattaaccattaactcgtcatttagcattaggtatatctcctaatgctatcccttccccctccccccaccccacaacagtccccaatgtgtgatgttccccttcctgtgtccatgcgttctcattgttcaattcccacctatgagtgagaacatgtggtgtttggtttttttgtccttgcaatagtttgctgagaatgatggtttccagcttcatccatgtccctacaaaggacatgaactcatccttttttatggctgcatagtattccatggtgtatatgtgccacattttcttgatccagtctatcattgttggacatttgggttggttccaagtctttgctattgtgaatagtgccgcaataaacatacatgttcatgtgtctttatagcagcatgatttataatcctttgggtatatacccagtaatgggatggctgggtcaaatggtatttctagttctagatgcctgaggaatcgccacactgacttccacaatggttgaactagtttacagtcccaccaacagtgtaaaagtgttatagttaagaatctcactgcacactttggccaaggcatccaatgttcccaattcttatttctccattcatgatgatactttgggcctctggaaacgaaaatagtaatattaatagataatacttacagagctcttgcttgttctaggtgattttaccttaagtcaccactcacaacaatgctaaaacgggataattattattactgtgtttatctttacagatgaaagagctgaaccatagaggtgttaaataacctgccaaaggtcctctaactaggaaatgacagaggtggatttgaatgctggcaacaatggctccagagtctgtgcacttaactgttatgtcagactgattctgtaacaggaaacattgcagaggtcgtgccaaatagaattcaccaagtactgaatgccccattagtccaacaatctactgactgtcagaaataaataggttgactttgttaccatggtgtctggacatcctcaaagttagattgttcttttggaagcccaaaggccacaatttcaatctcctagatcaaatttcattttccaaggtaacttatttacattctaggtccctggatccccagtccagcttttcctgtgcaaagaagtcatcttcaaagtaaaatttgttttattgtgcagttagtagttctctctcaagattattcagatgatagaataaataagttagacatagacatcaattgatattgatatagttatttcccatggagaagttggaggcttccccaagaatctatccactcaattgtcatagggtactactagcaccaagggtttatggacaaattgaaactgaaataatagagcatagtccttcaccaagttccatttggttttctaatcaatcagacaggaatatttgtgcatgagccttggcaatagctatacttccaagccaacaatttttggactgttgtcctcatttcttctatgacatcaacagcaatggggtttgtttctgttagagtttgaggtaatcataatctttataccaacttgagctcaggttgtaagaatacacgacccctttgatggatttaattatctagctgactcctccatcaaaattaattatgttgtggcagctttttctttctccattccctattatgaagactgatgactctgttaaattagaaaaagagaagaagaaacccttgaggttcctaagatatatacactttaagcccaattcaatcttgggtgctgcttgtggaatttcgggtactgctgccaattttcccatctcataaacaatgcctgtaggtgaagaattgttaataaattaaacctataccagaattcaatggggaagttcaggtattccttctgtattcttcccacaaccccattgtggccttgggaaacagttatgtgctggggactctgtacttctgctttctttgttttaaatttgtgagggtgaagtgatcagaaatctctgggtattcttggctcagaaccaaaccaacttcttccatgtcccctggaagcagagacctgtatataagatgcaataacaggcaggcagactttattgctcatcatggggcctcaggacatagccactctccttgaaaggtagggacactgttctctttctagaaatgataggtgagtttatttgcgaaactggaacccaccagattggtgtcttttttccaatgcatccctcttagataatcagttaaaaactgttttaacccaacattttaaaaagtcaggtttattaagatgtaatttacttgcagcaaactccaccctttttagaagtatggttctatgagttcttacaaacatgtacagttgtttacaactgattgtgctaccatcacaatcaaaatatagaatatttccatgcctctaaaagttcccttgtgctcctttttagttaactcttccctgctcccaccagctgctggtaagcactaatgcttagcacatagttttgccttctccgggatatacatggaatcatacaatatgtagccacctgattctggtttcttttactcatcataatgcgtttgacattcatccatattattgtgtgtatcaatagctcattcccttttattgctgaatagtatttcattgtgtggagagaccaaagttagtttatccattcactcatgaagggtgtttgggttgttttttgagcttctataaacattcatattcaggtttttgggtgaacgtacatttccatttctcttgggtaaattcctaagagtgggatcactgggtcatataataagcttatgtttgattttataagaaacttacccttttactcttccccagtctcttccattcctctctgaaaaggtaactactgttgacttgttgcaggggttcataatccccaagcctttagttcactattaaaagtttgttttctagacagtttttaagaaagtagttgccattgatcatttggtttaactttctagttctttgggttgtaataatcagaaagttatatagtatttccatatttcacatatggaaacttggcccacataatgggccaagtgccaaattttcaagtggttttttttttttttgagtggctattgccattcctggggttgggaagcctagactttccatcctaattggagaacccttgtgaagactagcaaaaagtcttcccagtgattctcatgaagatctctcttagaattcaccattgccttctgattgatcccatcttcaaatgctccctatatgttctctgacctacttctacatattcccatatcaactctctgagcaaaggcccctacaattttctcttatctctagtggcatgttgcctcatatcttatcttacttccatcagccacttggaaaacttttctgtacttaggacatgttcccttgccttaaaaactttcttggactcaactggacttcaaagttttcaatgataactgtccatcccacttcagggtgggtggatgggtgagcagagcagctttttggagttgcctccaggctactctgtcccccctccctcctgcatgttgtttgccttgaaaaccgtcttcgttgtttgatttgccttgacactttcatgtgcagacatgctttattagtggagctcagctgtgggtgggtgcaccacaatgacaaaagtttgtcccttgccttggcactccctaaatacctcatatctttcagacacattctttccatttaattcttaaagtaagatactctgccctacatcttagggaagattccctagtgaatcatcaagactatctttctaactccccacaattgtccctccatgtattagaactgttgtcctttgacctctagaatggaaactgactggcctgccactttcatctgttcacaaaaaataggtcagtgttgtcccacactttattcagtttgttcatgctccctctgtacacctcaacgagagggaaagttctgtcacgaattctggtaatgtgatccctttctctgtttttaatcttcccgttttcctgcctctccactaggaataactggctccaaaccagaacccaaagaatcttctgccccaaattcccacaggattgtgaatgtcacatttcttggcagtagatttttctggcacacttagtgctccccaaactgctactgacagtatgaagatgttggatgtctttccaattctggtggcagggcgagggaggtttacctgatctatttgtggactcagggcttcactaattctaatctgttgctgcagttgctcaaaatatatatattgtattcttatatattatgtatatatcaataataataattataattgaaataatattaataagcagcagccaggatgaatttttaactgggtaaatgcttcttggcctgagatgcagtggtgatgttcttgaataggttggggctgctcttggtttgaggggcagagatgaaatttggccagaagctgtcttaagctgtgaggggcccaggtgtgtgcactggtctaattgtgctgagagagtccttgtttggttagtgctgcctcttctgggaagagtagataagcagatctgggcaatgtcaacaaatactgacctgagaacacaatcttctccagccctgtaacctgtttctctgcctgtgttgcctatcagcaaatgtcaccactatggactgttgcccatgaagaaatcttagattcaatctatggggggcagggggagtggtggtctacctcttctattcctattttcctgcctctccactaggaacaactgggtctaaaccagaacctaaagaatcttctgccccaaattcccccaggatggtgaattcccctctatatcataattcttggcagtctcctcccccagtctccacaccacatcaatcttagttccacctaaacatcagttcttcccataaatgaccataaccactgctcggggtcttgccatcactagccctcatcaggatgaactggacagtctctacctcctccatgcttacaagcaaatgatctgtctccagggcatggcacgtctagattttcctattgtcaattatgcctgctaaactctttgtcatggtatgcaaggccctttatgacctggatccagtttatggctttagattcctagtcagtcatttccttcccttggcaatactgacctatctgcaatttcttaaaatatacccaccaaggtctctcatgaccagggattttcacttgcttttccctctcccaaactccttacttgtctgcttcacaaacttttacactttcttctggtcccatgtcaaatgctacttcatctatggggcttttctgataacccaggctgacctatgccgtctttcttcacctgttttgctgtatgttgtatatgtgacctctcgtataacaattgtgttcaataatttactgcctgtttatttttccctgggccaccgttacagtgaataactaggtctttaaaccaggcacttgaaaaataaaggaagctcaagtgttgtgtgtatggaaaaaagaaatgatagaaattgtcccaatccctctctcaagcatatctcctcattcctggccactggtaagaaactttccctccattttggtcatccacgtgagtgtgaagtcaccaggattgatgacaaaaatagaagaggattggaagacagtgagccaggtgccaaactcttcaataatgatggagtctgttgttgcctgcaaaaacgggggccagtgaacattacatcagtgtgtgtgagtcccaggtaagccaggtcttttcacctcctagctcaacacccgaagtatcccatgatatttggcagaatccaaaaaggaggacagagctagtgagggccagctgggcctggtagggcatgcttgtagccctagctacttgggagggtgaggcgagaggatccttgagcccaggaccatagctgcagtgagccatgatcatgccactgcactccagcctgggcgacagaacaggatactatttctaaaaaaaaatttaaaagttagtgaggcctaggccccatcccctgcttttgtatttttatataactggctcaaaagtactctcctagtcatatttattgttcacatagacattattgcaatgggtatgacattatttcaatgggtataacattatttaatatgagtctctaatcacttataatccactttttcaattaatctaagtcactttaaatgtgcgacaattactaaaactactactcccagtactagtactaccactactactattaataggaccttacaaatatcagtttttgtgttatcagagaaatacgagggtattgttaaatttgaatcggatgaattaccttttggtgtaattggttctaatattggtgatgcacattttcaagaattcaggtaacattaaacactcagtgaaatcacttagatttttacactgtattgatacatagtttatatttattccaaataagtatttgatcatgtccatttcaatgaattctgggatgaaatgcctatgagcacatctcccttaaaagcaaaggtgaaaattatgctcactgttattttatataagtagtagaagcagaaaattgtgacttataattcttcattgccctctaaaaagattaagtccttatgctggaggaccttttcttctgagtgcaaataaaataaaagcctcagaatggtggcctttcccacacttgaagtagtattaagtatggggtaagtgtccaatctgaagacagaagataaaacagagctcaatttatctgcatcaaaaaattgggagacattgaaagccctgctagtattagtggttgggttttatttatttatttattatttttacatagaatgtaagaaattctcgaatctagtttcaagtttagtgtcaggaaatggcacagggccgaccaggatagccgaacgtggaagttatatttaatttatacaaatcagtcttgtgtgaataaaggagtgtgttcacatgaaaagatctgtattcaccagccactagttaggctggggtggaaggggatttaactatgatctagctggaggcctgtggtctaaaggagatcagaacagaccctgtgtctccttattttggagatacatctagtgagagcccatagggcacctggggctacttcctgccatgttatgaatgtatcccctccaaaatttgtgttgaaacttagccctcattgtggtggtattaagaaatggggtctttggggaagtgacaaaggcagagagagccctcatgaatggattaatgctttatagaaggtctggagagaactagcctaggtcctatttgccattctgccttccaccatgccaagatgcagcaagaggacccttactatacatcaaacctattggcaccttgatcttggacttcccggactccagaactgtaagaaataaatttctattatttataagtcacccagtctcaggtatttggttacagcagcacaaatggactaagacactccaacagctgtggtcctggatgaagacctgggcttccatcgatattgcccaggggaacagcaaaggacatagtgtcacatagaactgacccctctgggatcagtcttattggaacctctggagatacttggtaacctctgcattcagggggaacaaaaacccttgacattctagttgaaaatgatatggtagacaattactgctgagaattcaatttcctcctatttttatttgacattcctttttcaagagattacagttgttttgttttgtgtaacctccactcagtttcccccaatggtcacatcttgtgtaacagaagatgggcattggaacaatgttgtgtgtatagctctacatcatctcatcatgtagatcccacaagcaagatacagaactgttccatcaccacaaaggtcttcctcctgctgcccctttgtagtcatactcactcccctcccacctaccattcctaatccctggtgaccactaatctgtttcccatctctgtaattctgtcacttcaagaatgtcatgtaaattgaatcatacagtttgtgatcttttgcaaatggattttgtccccactcaacataatgcccttgagacctattcaagttgtgtgtatagtttgtccttttattggtgaatagtattccatagtatggatgtatcacaatatgtttaaccattcatctattaaagaacatttggggttgtttccaggctttttttttttttttttttttttttgagatagggtttgtcacccaggctggagtgcaggtgtgcaggtgcagtgatgtgatcatagctcactgcagccttgaactcctgggctcaagcaatcctcccacttcagcctccctagtagctgagactacaggccagtgccaccacacctggctaattttgtttccagtttttgatattaatatgttagggcttaagtctgacattttatttatttatttgtgtttgatgtctttgttttttgtttctctattctttttcctgccttcctgtgagttacttgaacatttcttttttagaattgaatttctatttacctatagtgtttttaaagtgtatctctttgtatcatttttattattggttgctctagctattacaatatatatacagacctcttcacattctactggtgttgacattttaccactttggttgaagtgtagaaccttacctctctttactctacttcctttataatttaattgtcttaaatagttcctctccatacattgagaaccatatcagatagtgttataatttttgttttaactatcaaacataatttaggaaactcaagaggaaaaggacaaatctattatatttacctatatttttttgttttgttttttgttttgagagagggtctcactctgttgcccagactggagtgcagtggcatgatctcagctcactgcaacctccgcctcccaggctcaagcctgcctcagcctctcaagtagctgaggttacaggcacgcaccaccatgtctgggtaatttttgtatttttagtagagttggggtttcatcatgttggccaggctggtgttgaactgctgatctcaggtgatccacccacctcagcctctcagagtgctgggattacaggcgtgagccactgcacctggcccagccattcttttaagtcaggtttgctggtggcaaattctctcagttttcttcaactgagaacatcttgatttccccttcattcctgaaggatatttttgctagatatggaattctggattgacagttctttccttcagcagatgaaaaatgttgtgccacttacttcttgcctccatggttttttggtgagaaattctctgtgatcgaaattgtttttcccctatagacaaggtggtgtttctctcttactgccttcaagattttgttttcaaaagttagactatgatgtgtcctggtatggatttctttgtgtttatcctatttgagacttattcaacttcttgaatctgtaagtttatgtcttgggaaattttcagccattgtttctttgaatactttttcagcctcatctttttttctcctctctttaacttccatgacacaaatgtttgatcttttattatagtcccacacgttccccaggtctgtttattttttttttcttgactgttttctctctgtaattcacactgggtaatttctatttttctatcttcaagttcactgattctttcctctgtccattttattctgctattgaatccatctactatgttttacaatttgttatcatgtttttcagttttaaaatatctggtcgggtgcagtggctcactcctataatcccagcactttgggaggccaaagtgggcggatcacttgagatcaggagttcgagaccagcctggccatctctactaaaaatacaaaaaaaaaaaaaattagctgggtctggtggcaggagcatgtaatcccagctacttgggaggccgaggcaggagtatcgcttggacctgggaggtggagattgcaatgagctgagattgcaccactgcactccagcctgggagagaaaatgaggctccatctcaaacaaacaaacaacccccccgccaaaaaaatccatttagttctttttatgtcttctatttatttgctgggactttatactttttcatttgtcttgcttatgtttgtaatttattgtcaaagcatctttatgaacatctgtgtcatcttgtggttggtgtctcttgattgtcttttttctcatttgagattttcctggcttttgatataagtgatttttttatcgaaagctggatatttggagtgttaagttatgagactctggatcttctgttttatcagcctccttctgacactggtctgacaggaaaaggggagcgccacttcattatggtcaggtggagtagaagtccagattctccattcagcctcctttgatactgggaggagggtctccccattactccttggcaatgtgggagttcatgttccccacaatgcttctgctgatagcacacaggccaagaggggcagggatgccttgttatggttccttatgctctccactaacaccatggtggtaatggtcgggggtgtgcttgtaactgctggctggttgtgaaagtgctgattttacactagacctcctctgataccactccagtgggtaaaagaggagggaccccctccttatttccaggtggctgtggaagtccaggcttcctatgtagtctccactggcactgtgtcagagggggcttgttattgcccagaactaataagttttggctcccaacttgcctttctctgacgcctccctgatgggggatttgggcactttgttacagcctgccaagggtggaagtccaagtttcccatttggcctctgttagcatgggtggtaccgcaattttttctgtggtgttggtttggagtagagtggtgattattacctaaaactcttctgtcatgaaaggttgcccctttcctgttcctttgcctagagagagtaggctttttttaagccttaaagcttctttctttctttctctctctctttctttctttctttccttttttgtctatgctcattggtgtttccaggttatcagcttctccagcacccagtccagcatatacgagggaaaaacatcctcaggggactcactgctgtgtcattcctgtgtcattctgaggtctatagctatctgccttatactatctacttttcagagtcttcttatgtttatgttttatacaatgtccagggtctataactttacttagcaggtagaaaagggaaaagtacacctaccacatctttctggaaacagaaattctattgctttgtttggaaaaatcattttatcatggaaagatttaaatatacacaaaaagtagagagataagtaaaatgaaccccgtttactcagcttcaacaattttaaacattttgcgactcttctttcatttatcctccccaccctaagatttgtgggagtcttttaaatgcaaatcctagatattatatgagttcacttaatgtgagtatgcatctctaacagaaaattcttttacataactacaataccattaccacaattttttaattaataattcctaaatataattaaataccaattcatattcaaatctccatgattgtgtcaagaagtacttttaaagctgatttaaaaaaaaataggatccaaactgaatgtagcatttaatttggttgttaatcaggtcatttttcctataaaatatcccacgttctggatttggctgattgtttcccagtggtgacatcaaacttgttcttctatctcctatattcaccataaactgggagttagagagctagacatttgattagatttcggttcaatttttacttttggcattatcaatacatcacaggtgatgctgcatgcttcctattgtatcacatcaggaggcacctaatatgtagctcttccactcagtgatgctcaaattgattggtgggttcagttggtatcaacctgatccctcctttgtaaagttccaacagctattttacctaatcttttttatctgttcatgatcattgccctagataagtggttctcaactagaggaaattttgtcccccagaggacatttgacaaagtctggagacatttttttatggtcatgactggttggggggtggcggatgggggagtgctattagcatttagtggataggtgccagagatgctgctaaaaatccttcagtgcataggacagcccccagataattatctagccactaatgtcaatagtgccagggttaagcaaccttggcctggatctattatttcattagggattgcaaagggggatatactaattctacaatttctcctgcattttctgtttgaaattgttgcatataaaagaacgtctttaagtatttggttaccctgaaatgcagttcatactggaaaggtgacataaattcttgatttttctctttattttatttttgcaataatgatttgttgccctagtatcactcaggggtgaccaatgtttttaaatgtcattatgaactcatgtattttatacatttgatgcttcatgaactgcagcatctttaattgtcccaatataggcaagtgagaaccctttcataatggttcctgtgttcttttggcataactccattagtctttgatatctcatttgctttctagcaaaccaagatgttccagactcattttgtatttttcctgttacagacctggaaacatcatttctccaaggaggattggctccttttggtaggaaatgatatgtagagaccattctgctatgtcttttcagtggacagaactagaaaatatgtactttttagaaaaagaaaaataaattataagttcacgtggatatttgtattctaaaagtaagactacagagtttttttctttttgaattttataactgcatgattttccttactttatgttaaaaatcttgattcctgacaacattatcataattacttatttgttttatcctacaacatacatttaacagtttcaaaataataataccaataatactactagaaaaagactactgaacacagttccttttttctttggggtatatcccatgggagatgtatagtcagaacattgtttctaagttacttgaaataaacattttctttgtgtggttataccatcaatttgctacacagttagggtcatttgattcagtttgcttttagagatttttttttctttttaattgacaggattctaaagtcaaagctgtaaaacaagggactttagaaacatctcattttcttgcctattccctccaccctatttcctccttcccccataagtaaccatttaagttaatttacattccattgtaccatttatttctaagatgtaagtaaatgtttctgtaaatatttgtatttccccaactttcttacccaaaaggtagcatactatatacaatgatctgtacttggtttgtccacttaacaatatattccagctgttaatcctaatctcactatatagaaatctgtctcattccataatacttcatttcatggctccactacaatttattcaactactcccttagtggtggacatttattttcctccagtcttttgttattacacatagtgctgcaatgaatgaccttgtgcatatgtcattttgtatctttgggtcagattcccagaagtgggattactgagtcaaatagtgaatacacatgtaattgtggagacattgctgaatttccttctattgaggttatataatttcatttgtattgctttttgtggttttaaaaggattaatattttgaaaaagaattaaaagtgtgattaagatttttatctgccaatttgggtgcaatatacccttccccactcttcaagcttgaaagaggcattcaggacaagcacaagaagtcagattccaaacttcggtgagtaaaattgcagaatgtgttattcgtggtgcttctgtctaagctcaggcccagggccagctatatcccacagggctaactccagcactggacacagatttggggattccagggttttcctaaaaggcaggggcaagatagataggcagtttgccaggtgttgtgccagcatgcaggaggctggtacagagcccatgtaatgcagatagatagagaatcaaaagtataagtcaaatgggccatcattctgaaggggtacagtcagaggtactgaagactgaggggtgctaagaaacagactagctgggggcactatgtggtgaaaactggggaaatagctggtcatggtatgatgcagtataatctacatcattgctgtcatctcttataaccttgactttgctgtctctttgagcctttcctttctttcagccagagaagggcttgggccattggaatcacatgggtgcaggctacctagggctagatgtgtgcttgaaggaaggcttgggctcctccattccctgccccttccacaccactagccttgcttcttccctctgtagggctggaatctcctggaagcctgtggtagatcctgatgaccccattcctcagttccctgattgctggtatggctacaggagtacaggatgcaaggcctagtcctgctgcattggtagcaggggttgctgagctgactcccttggtaatcatgaatgggccagcagcatggctattcctaagcagttgggcatggtccaaatggatgggaggagcctacctgatcaactcttagacctaggggccctggtgctaaatggatttgctctttcccttttctttacctgcgtaaagacttgcaggccactagtgagacatcagtggcatggaaaaagtaggcatcagacatctcgttgttgaaattaggtatattctgaataggaagaggcatagaagcaaaaagtaagcgtaggcaaattgaaggtacttaaggtttttgtgcctcagtttcctcatctgtatagtgagaataatattagtacctaccccatcagggtgtgataagacacttataaaacactgcctggcatatcataagcaattaataaatgttagttactattattatgatttgattacaattattgtatgtaaaccataaatcatttcatgtcatttccttgcttaaaagctttcaaatgattctcattgcaattgagacaatattcaaattctatataattgtctacaaagctccaggtaatctggcccctgcctgcacctctatcttcatcctccacttatgccactctcctccttcttggtcactaagctcaagcccttctggccttattttcgtttgttgaaatcatcaagcccccaccctttttttttgtctcgggcccttttcccttgctctatacttttataatcaggaaaaaaaaactttcacaaatacaacaccaaaattcaggatccacaaataaaagtttcagaaacttgtttacataataatcttaaacatcatatggtaaaaaataaagtaaaatacaacagccaatgataaatgggaaaaacacatatgtacactagactctgacacacaatgggctagtagctaacagcccaacctcttgggtgtctctcaatctctctgtgcctcagttccttcacatgtaaaatggggatgataacagcacctacttctcaaaattgtggtgaggtttaaataatttaatagagcagcttttggcatacttcaagtaccatacaagtgttacttatgataatgattaataagaagccacaagaaaaataggcaaaggatgtcaataggcagtttgcaaaaaaggtaatacaaaatgatcaataaacataagaaaatatggttgatttcatgcacaatgaaaaacatacatttgttcattttacaaatatttaaatatgtattaagtcccaaggaggcattgggaatacaatagtaaacattttactctcatggagtttatattgattatgtgtgtgtgtgtgtaatatataatatatcatgtggtggtgatttaacatatcatgtggtgatggtgtttaagggaagagctttccaaaaaaaaaaaaaaagaagaagaagaagaaacaataagggcataggcctggaagcagaagccagcttagcttattcaaagaacagcaataaatcgagtttgtttgaggcaatgctaagttgatagaaagtgaggtctaagagtctaaggccagaatcagtagggccttaaaggccaggaaaagaacttgaaattccatcaggagtgaaaataagaagcttgctatcacctaggaatattgtattcagctacatataaccaggttccaaataacaaagacttaaataggatgacattttgagcattacactgatcttaagacactattgcctgtgagacactccagtatattatgtgccaccaagaaagaaaaaaaaatgctgccaaatataatcataaattgtcatttaaagatttcagggatgttgaaaatctttaaatgattttcatttaagatgtacctcttagagttgacaaaatatgatatatttttttctcatgtaaggataggtccagaggtgatcagctttttggtctttccatcatgattggttgcaaaatggctataagctatagcctttaaatcctcatttccagaaaggagaaagagaaatcaggaagggggaaaatgccttttagtttttatagtaatttaaggatcactttttaaagtctaccccaaaaaactcattggaagtttttactggcattgcactgggtgtgtagatcaatttggagagaacttctatatattacagtctaatttatatttcattaaaaaaatacagctggacctccatatccgtgggttccgagtcatgggattcaaccaaacacagatggaaaatattcaggaaaaaaaaaggatggttgcatctgtaccaaacaggtacagactttttttcttgtcactattccctaaaccaggggtctccaacccggggggccacctgttaggaaccgggccgcacagcaggaggtgagcagcgggcgggccagcattatggcctgagctccgcctcttgtcagatcagcagcggcattagattctcataggagcatgaacgctattgtgaactgtgcatgcgagggatctaagttgcacgcgccttatgagaatctaatgcctggtgatctgaggtggcacagtttcatccggaaaccatctccccgcccctgaagccccccatcccttcccaaccgccgttaaaaaaaaaaagtcttccacaaaacgggtccctggtggtgccaaacaggttagggatcgctgccctaaacaatagagtacggcaactatttacatagcatctgcattgtatcaggtatgatacaaaaagtaacctagagatgattcaaagtaacctagagatgattcaaagtaacctagagatgattcaaagtatatgaggggctgtgtataggttatatgcaaatactacacaacattttatatcagggacctgaatctctatggattttggtatccacaggggtcctggaaccaatctcccacggattaccaagggacaactgcatgtataaaacatgcttgtatttgcatagacaatttcttaaaggctaaatgtgaaagtgctaacaagtagttatctcaggggaataaaaatgggtgtgattggcgggggagggaagagctttaacttttcatgttatgccttgtataccttgttattaaaaaaacacgaatattgtatatattacttttataataataaatataaactagcaacttttaaagtggaatgtgcatcaccctggagtacaggagttttaaggggatcaatttctatatcctcaaatttcctgtgtagtcttttaaaattgacctgccagagaacatacttgcagtgtaggaatcaaactggttctctttttctatctcccctttcacaatggtcctttttgcactttacaaaagaaaaagcatatcttttacctatcctgaatcttaacctgggtgcgctgccctgtgatgtaaaatccttggggcacaggagagacaattccgaacaatgctgacgatggtaaacaaacaacttgctctaacaaatgaatggggataaaatccttttgcaactcagatggtttccaattctttgcttccagtagaattgaagaaaaaacctatgaagttatcagctgataaatcatgagaaataattttgaggataaatcattgtgtaatttccccccatatatctccaaaggaattcaaagacttgcgtgcattgctaaaacaaaatgtccattcctattcacttattcatataaatgaggtttctgtgtgctaacatttaaccaaacaaaaaataggaagagaattgatgctgaagcctatctcattctagcaaaaagcaatgtttatccatggatacacccattaattttttttaaaaaagccctatctacaatgaacttttgttttacgtttaataattacctatcaaaatttgtaatatattcacaatgttttgatccattttattctaatactaattgtcatgataattcaaacaagagcaaatttttaaacaacacttagagccttataatcagaggaacatttaaagagcatttaaattgaaaaatatatacacatttttgctgcagagaaatacgataggataatcaaaaacatttcaagtgaaaaaacagacaattattgagacaaaattctgttggaaaaacagaatggaattaagagctgagaaaagggaaaatgtacaacttccaagtatcaaagaagagctcagttatacatttttaaaacagatgatggtggctctcaagtcactaaggtatttaggtttcaccggattcatgtgaaatagtgacataacagttttatttttgaatattaacatttgtcacaaattacattatttgtagccaattgacatttgtgatgcaaaatatcagacatcaacccaaaaatgtgtgaaggagcacacgtttttcttaatatttttagagagcattttatataaaccaatagttttatataaacatacaaaacatatatgaggaattgtcatttactcttttgccaccttgtggtcagagttggatttatcacccaggtgcatctactgcgaaggagagctgtctctcctaaggatagccccaactgcctgcattctgtcagatctttgtgaggcagagatggtaacatttgctaggatctgggtccagatccacataaggacaaagcatctaaagattttggtgacaccctccacacgtgattcaaaacaaaagcatcatgtaatcaggaaatgaatgtaaggaagtacaacaaagttctgatttttcccacgaggactacttaaaaaaaatcaaatgtcaaactgtttctggtattttttcttttttgattttttgtctttggtgcctcttctctgctagtgacatagactttccttagtgtgccttttggggaagccatccctgatttcagtagccctggagtaagttggagtgctgtgtccacagctcttggtacatctggccctcggtcagtgcagaataaacatttgttgagtgaatggtgacagagccctccattttcagaacacgctggcctgggcagagtccaggtggacctatgggcttctgcaggaagttgatcactaagtcaacaagttaccatggctaatcttcaatggtagacagtcccaggtacacagagatctttaggtctttttgttgtcagtctggaggtgggatgagagtatcctccaccccctcatccatgacctcggttgtttttagcagcagcagcagcagcaggattccttcagtgagtgtgctagttgcagttcctctggttgcaggccacaaagggcaggcatttattgaaaggatgctggggtgcttcaaggaattgaagcaagagctgactcaggaagggtagggcccagggcaaccctcagttttatgggaaccacgcatcctcctttcaagggctcctgattcctgaggcccaactcctgctgctaaccctaggaggcctccccatcccctccctagaggaaggggccaggtggagagctgatgtccagtgctgagcaaggagaatgttgctagggtatgtatactcaggcagcacagccacacaagccagacagcgtgcactaggctacagccagccaccaccaggattaggggactagactcttcctagaacactctttctcctcctactcctgtcctgatgcctgccctgggctgcactctctgggaccagcagctacagcccgacaccctcgagccatgacccaggtctgagccacttgctctgggcacactcctcgtgggctctggggtgctgctgcccagtgccagcagccccttggcacaggggttcccagaggcctctcagcctcatgtccgactccctctccctgctggcagctccacaggcttctttccacttccacctgctgcccccctcccccgggatgctgccagggcttaagggtcttgggagtgtgtcctgtagtttaggccccctctcagctgtaggggaagtgccagctgtagggatggccttgtcgtgcctcgtccctccagctggccttggagagaagaggtggattgtgccatcgggctgctcagcgtctgctgggccaggaggccggctgtcaagccattaacccacccgtggccttgggagcccaggaggacgcgagcagcaggcccagaccctgcagagcgctgataagatgggccagggacgcgcctctccaggcccagcggccttggtagcccggcccccccggagctggggtccaggcctccccagaactgcagctggagcttcatccttttcgggaagcgcaggacctggcgtgggaagggagacagggacgaggctagaggcaggctcggccgccgaaatgatggcctgtcacggcttctgcctgcgctccctaggacccccctcagaggggacatttcacagcctcagaaacatttctggacttggcacccgctcggcccccagccccgcagtggccgagggaagcctgcatagacgaggggaaggacgaggagaggggaggagacgatgaagggggtcagagcagcgattggagccgagagctggaagcgccttaaagagactgcgcggtccccgccccccttcccgccagcctcaatgaattagagctgtgtttcccaaacttgcctgatcataagcagcctctggggccctagttagagatacaggttccggagtacctcccttcgagattctgattcagtaggcctgcgggtggagccaaggaatctgtaattttaacacgctccccacgtgattctcgtgaacaagcaagtttggaaaatactgaattaaaggaaacggggcctggctgcagaagcagcctccactagggggcttcggcgggaggattcccgggggcgtcgcctgcttccgccgccgcctccttcagtgaaagtcccttttgggtccagctgccacagccaccgcgctccctcaggccgggcgggggacaccccaggtctgcgtggcccccgcgccgccacgcccagtggccgcccgagccctgcgagcagggggaggagccgccgccagtggaggcggaggaggtagaggaggcggagacggcggagaaggcggagaggaaggtggaggcggaggcgaaggtggaggggaaggcggaggcggcggggaaggcggaggcggcggggaaggtggacgccaccgagaaggtggagacggcggggaaggtggacgccgctgggaaggtggagacggcggagggtccgggccgccgggctgagctcaagctggagcccgaacccgagccggtccgggaggcggagcaggagccgaagcaggagctggaggatgagaacccagcgcggagcggcggtggcggcaacagcgacgaggttcctccccccacccttccctccgatccaccgcggccccccgatccctctccgcgtcgcagtcgtgcgccgcgccgccgaccccggccccggccccagacccggctccgtaccccgccgcagcctaggccccggcccccgccccggccccggccccggcgcggccctgggggcggatgcctggatgtggattttgccgtggggccaccaggctgttctcacgtgaacagctttaaggtgggagagaactggaggcaggaactgcgggttatctaccagtgcttcgtgtggtgtggaaccccagagaccaggaaaagcaaggcaaagtcctgcatctgccatgtgtgtggcacccatctgaacagactccactcttgcctttcctgtgtcttctttggctgcttcacggagaaacacattcacgagcacgcagagacgaaacaacacaacttagcagtagacctgtattacggaggtatatactgctttatgtgtaaggactatgtatatgacaaagacattgagcaaattgccaaagaagagcaaggagaagctttgaaattacaagcctccacctcaacagaggtttctcaccagcagtgttcagtgccaggccttggtgagaaattcccaacctgggaaacaaccaaaccagaattagaactgctggggcacaacccgaggagaagaagaatcacctccagctttacgatcggtttaagaggactcatcaatcttggcaacacgtgctttatgaactgcattgtccaggccctcacccacacgccgatactgagagatttctttctctctgacaggcaccgatgtgagatgccgagtcccgagttgtgtctggtctgtgagatgtcgtcgctgtttcgggagttgtattctggaaacccgtctcctcatgtgccctataagttactgcacctggtgtggatacatgcccgccatttagcagggtacaggcaacaggatgcccacgagttcctcattgcagcgttagatgtcctgcacaggcactgcaaaggtgatgatgtcgggaaggcggccaacaatcccaaccactgtaactgcatcatagaccaaatcttcacaggtggcctgcagtctgatgtcacctgtcaagcctgccatggcgtctccaccacgatagacccatgctgggacattagtttggacttgcctggctcttgcacctccttctggcccatgagcccagggagggagagcagtgtgaacggggaaagccacataccaggaatcaccaccctcacggactgcttgcggaggtttacgaggccagagcacttaggaagcagtgccaaaatcaaatgtggtagttgccaaagctaccaggaatctaccaaacagctcacaatgaataaattacctgtcgttgcctgttttcatttcaaacggtttgaacattcagcgaaacagaggcgcaagatcactacatacatttcctttcctctggagctggatatgacgccgtttatggcctcaagtaaagagagcagaatgaatggacaattgcagctgccaaccaatagtggaaacaacgaaaataagtattccttgtttgctgtggttaatcaccaaggaaccttggagagtggccactataccagcttcatccggcaccacaaggaccagtggttcaagtgtgatgatgccgtcatcactaaggccagtattaaggacgtactggacagtgaagggtatttactgttctatcacaaacaggtgctagaacatgagtcagaaaaagtgaaagaaatgaacacacaagcctactgaagtgacacacagacctacctgcaatggaagatgacgacaccaatactacaactggcatcgagatctaaaggacctacttgaccatggcccatgggcctgacagagtaagaattgaacagtacccagtgtccaaaaggtcctgattggaagagaaatagaaggggagggagaagaggctctagtctaagcagttgatgaaagggaaattaaatggtagaaacactctgggtgaggaaggcaggagcaggaaaatgctgacactggtacatatcctatattcctccaaaagattgtgtgggaaagtgtgggggggaggggggtggtggggggggagtgtgcccttgtaaccgtaaaacatctttctccatgggtgtttcagcttcaattgaccaatcacataacagttatatgtttggggggaaaaagaaaagtttctaaaaaatgtagcccattacatatatgggtatgaaagcagaaaagtggaggaggcagggatatcattgacaaacacctttgccagtttctttgtattcgtgattttttgtgctattaaatgcagtattaaaacaagaaaagcccacctgggctagtgaaaggagaggaaataagggggcttgtaaaaggggagccgtcgctccaaaagtagagaagacaagaaatgctgtaagataagcaaccaacgcagacaggcctcagctaagagtatagtgtgtgtgtgttaaaaaaaaaaaaaaaaaaaagaaaaaaaaaagctgtatgatatacttgagcaaatcaatgaacctctttgcgattgttttatcatctgtaaaatgcagataattcctaccttaaagggttattgttaaagataaaatgatataaaaatgtgtcaaagtataaagtaaaaggcttggaactttgtagggactcagtaaacgtttgttggatccaaacctgaaacttctttggaccaggcccagaatgcatcagaggtgggggtcagtcctgcctgagacccctggacagaagggacacacatcatgtcacatacagtcacacacacattctccacaactccctccccaatgctgtctatttagagtaccaaggcaatgaactccacttttgtcccttgtgtgcagggcatcacagtgggtgccacctgggattgggggtggaaaggaccacagctgtcccataaggtcattattctgtccttttggaggacagtcatgttgctttcatgattcagatcccagtgatgggactctcatggccagtaggctgccaggcttgcacacgagggaatttggtggtcttcgtcttctaaaaacattatgggttcggttgctatgtttactcacaggcacagatcagtagaaagactgttttccaaagttcactggcccatcagcccagggatattgatagagtggcttgttggccccttccctgatactgtcagagggcagagcagcctgcagagagctaagccaaaacagatgggatgaacccaggatggggtaagcactatgagtccttctctcatcagcatcaggtacaaaagtaattgttacctagataatcctggagggaaattgaatgcgtatcacatccatggggcttggatccactggctctggtaaaaggctgggctccccattgcttcccaagtctacttcatggtcaactcatttggaaatatatgtttatttacgtggctgtgggtgcatcacaactagcttataggcttttttaggacaggagttgtgtctcctcttgtaccttgggatgcattctcattcccttagctcctgtcacatggtaagtaggtattcaaaacatttactgaatgaatgaatggatggatgagttaatgaaccaatacaccttcctttcataaccgagatttcattaacacctagggctcataattttcaggagaaaatgtaaaaagttgttatttttggtgtcttgtaggatgggggagctcaagagatgggtgactttggatggcacttggcaacttcgtgcagggtgtctgactaccttttgggatgggtctggtatccctacctggaagaacacagccatgtcctcattcttcatctctgccaggggaagagtccaggcaggcctgtgccaccagatcctgactgcttgcacagaaactgacctttaaaaattttaaacatttttatttggaaatcatttcaagtttacagaaaagttataaaaaatagtataaagagcatctgtatgctctataccagatttacctgttgggaaattttacctcatttgtattatcatttgcacatgtgcactcttttataaatgggggtgtgtatttttgaacgatatgaagataaattaattacatatatcatggccctccatgcctaaatatgtcagtgtgcatttcctaaaaataggcatattccccacatcactacagtagagcttcagaaaatttaacattgatagaatacattaatctacgatttgtattccaattttgtctggtgacccagtaaggtcctttatagcattttcccactctattgcaggatctggtttagggtgaagtattgcatttagttgtcatctctctttagcctcctttaatctggaacatttccacaacctttcttcatcttgtatgacattcacatttttaatagcacattcctcattttgggtttgtctgatacagaaaacccttttaaataccctgcactcaaccatagttctaagaggaactcactgagagctatgaatggcaagagatgctgaacctgacctccctgtctcggctggtggaaggcacagaccgccagggggagcagctgtgctgggcactttctaattgaacctcatgcctcctatatctggaaaacagcattgtcccttagcaacagggcagccattcaaggccagtcctatgcccctacgagtcactaacccccaaattgagcaatggaatgtaacagcagccagagcctgccttcagatcataccatcgtggaacccaaggcatcatgtattcagcaggtatgtgttaaccttgagctcaaactgagatccaggcatgtttgagaatgtctggcacatggtcaggcacctccacgattagggcctttaggggtatcaggaagtagcacccttggcaccttcactaacgttcccacggtgagcacaaatacagcagtggcaggggtggggagggaaggggtaactagttctcaaacagcttcatggtcagagtacacaaagataggggcccagaataagtaagaaagaacatgggagatggtgaaaacggattggtttgtaacctactggggacttgcagacacaattgggttatttttcatgtgggctggagttcctagatgagcagatgggacaagaaccagtgaaatttaagctaattctttttttttttttttttttgagacagagtcttgctctgtcgcccaggctggagtgcagtgcaatggcgtgatctcagctcaccgcaacctctgcctcctaggttcaagcaattctcctgcctcagcctaccgagtagctgggattacaggcgcccaccaccacacccagctaattttttgtatttttagtagagacagggttttgccatgttggccaggctggtctcaaactcctgacttcaggtgatccacccgccttggcctcccaaagtgctgggattacaggtgtgagccactgcgcccagctaagctaattctttagcagagacttcatttacatccacatactgttaggactgggagacttggttcgtatgtaggtttgtgatctggactcagaggggcacaggtgaaatatgggtgctcacaactgggggcattaaccacccacagagttcagaaccatgtaccaaacaatgagatactgccctgtcacccattacacatttcttcccacaatttcgtggcataatttgattagaaatccaggaccctgccatttaccatttcttggagtagccagatgctaaaactgactctggcctgcaggtcacattggtaactgtctcacttattcactgtctacagggaattctgatcagggacgccatcaaccaaaaggcctttttccgatcaagaaacagagtggcccccacgcaactcttactttcaaatccagtagacctggtgccagaaacctgtgtttcctccaaatgtatgtttcacacccagaaacgaaggcccagatcctctgaaagtatgtagcccagcactcaccacagtgtgtcattacacacttgctctgcaggtgagacccagtgccatttttaaactcttatattgaagtatatcaaatatacaggaaaagtgcacatatcatttataacttgatgaatttctacaaagtaaacatatccctgtaagcagcatccagatcaagaaacaaaacattccccagaactcaaagacacctatcttaacttcttttcactgtagattagtgttgtctgtctttagaccttctctaaatgcagttgttcagcatgtactcttttatgtctggcttcttttgttcgatagtcattttatgaacttcagacctcgagtcttttttttttttaaagtaataccctctcagagaggagagagtgggctggcctctgtgaaatgagatcagcctgaagtctttttgtcaagaaaaattaggaggaacttcattatttctgtctaatgaactaagagtaggaatccctactcgtccctgtgatttatttgtttgtttgtttgttttatttatttattttcttttgagatggggtctcactctgtcacccaggctggagtgcaatggtgcaatcatgcagtgtcgacctcctgggctcaaacaatcctcccacctcagcctcctgatattgaatcaattcggagggactcaggccattgcaaagttgtgtctttgccttgagaatgtctataatctcactcaggtacaagaaagtgtctcaagagtgtctgtaatatcactcaggtaaaagaaaatggtggatggaaaataaccttccaaagaagcttgggttaatttaagcacccaagaaatgttaatcttgggcaacacttcagccttgttccagtagctcctgaatgcaatattctggtaatttctcaaactttaatatgcatcagaggtcctcatgtaccaagagggctcattaacacacagattgctgggtcccacccccagagtttctggttcagtagatctgggatgggggcttgagaatttgcatttctaacacatccccaggtgatgcccatactcctagttctgggaccacactttgagaaccactgatctattcgttatctcaccttcctggagtccaaggagtctatgaagatggcccagggagcaccttggagagcactgcagggagcaaggaaaataagttggtgagatcagaactctcaaccccacttcaaccagagaagctctcctcttatttgtttggtatttgggggttccaggtaatacttgcagaaagggttctgctactaaactattttaaagttgaaactcactgtggtaagaaattttagaccccaggggaatgatatacttaaacgacctggtggtgtgtctggaaagtaatccagcctgctacagaggcctggcctcatgtgcactcacaatctagatggtcctgaggggagacttaatttctttagaacttaaagaagtggatatttatgaggatggaaatgataaggaagaatgcttaattataaaaaggtgccaaattgtgtgtataaaacatggtttcttctggcaacacagcacactaagatgatataactagtgcctcgttcccactacaaacatagattaacactagatcaactagaacaaaaatttacatttctagctgagctttaaaaaataaaaatcaaaatctctagggaaacaaaaggaaaaacaaaaggcagtgtagtagttgtaaacagacactgcagtgtcctgtgtggtattggttccagatatcaggccctgagggctagggacttggagctgggagtccaatacccatccaggtgctgacaacacagcttcaggtccaccacaggcagaggagctataggtgaaacctctgggtaaagcctttagtaacttctcttgtccattaaaagggggttgaagaataaacaatgaaagggcttatgttgtctctggaaccacaaggagaaataaaaatcccaggcctatgttctatgtggatgtggggtcaaaatttactgtgtggtatgggaatcacatgctgaaaaattaaaagctgggacagaaccattgaaacctatagaatctcagcaaaagcaaatgcaatacatttttatgatccagggtaatggaaccccacagaaaaagaaaggatctgctgaagatgggctcagaaataagcaacaataaaaatcaagtccttgcatataaatgatacgccatgaaggagagtcaccagttgccataaggagaattagtacccccaagaaatactgctgagaagaactgctactctttttttgagagtgaaatgaggaaattttcagggaaaaaaaacaaaactaaactaagaaaatttagcaataatagcctctcacaagaataactaccacaagagatacttcacgaaggaggaacttgaaagtagggagaaggggtgaataggaggcaaggaacagtgaacaaaaattgtaaacgtggggaaatctaaatgagcattaattatataaggcaataataatgctaaagaatatgggagtataaaaacaagctggcactaaaaacacagaagcacacaaaaacatgtaggacacaccccataaatatgtgcaactattatgtattcataaaaagaaaaataaacatgtaagacagcagggcactattcatatttaaagcattctaaggtggttgtattgtttggaaagacagtagggatattgcctgaatttagaccttgttaagtcaagtatgaatgtttaaccatttaagagtatggacttctaggttctggcaatggcagaattagttatttgatttgacttcattattgaattaatgaagaaatgctgaataaaatatttcaaaactactttaaaagcactgaagagctgagaggacaaaggaaaacttccaggccaacttttggatgacagctgcaaccaaacaggtaaacagaatatagaggcatcaaagccaatttgatttaagggcatttgcctacactgcccacctgagctttgattcaatggccacacaggattgggggaaagaaggcaaggctcaggatcaacccaaggtaggagtttaatagggaaccctctccacattaacctgagaccccaagggactatctctgcagcctgagggccatccagaactaagcctattatagatttagttatagtaggagcttctgttcccaatactccctgagaactataccgaagtctgccttggtgctaagtagagctctcttgctaaaaaagaaagggttaaaaagaaggctacaaaatctattcctgagaagatgaggccacactccagccctcagacagattgactcccctattatccatggcctgggtcagctacagaacttcaaaccatgaacttagttgtgggtggctgccagacaggtagcactccaaggtgctcagtagaaacaaatacaaaatctctggaggagaataaatccatctcaggcctcagggaaccgccacaaataaattgtcacaggcaatgatcagaaagcaggctaaaatagtcagttgcataatgaaacaaggtaacttgacttagaaccagcagggaaaggaaacaatagaaacaaacttgctcaggcttcatatcacagagttattagacacattttaaaatgaccatgtgttctatgtttaaagaaatagattattaatctgaaaatatctgcagagaagaggaacccataaaaagtgacatggcatattgtggggaaaagagggggaaaaacttctaaaagtgaagaaatgaaaatatgggatagagaggagagatgtggaggatgtaattaggaaatctagcatacattgattacaatatgagaggaagataatatgactacgaaatactgttactattcatatacttaatattcaataattcaaaagttgacaatgttaatattaaataataataatggttgagtattttaatagacccaatgaaagaaatcaatccacacatttaagaagcccaacaaataccaagtaggataaataaaaagaaatctacacccagatactgcagaaaaacgaagagaaagagaaaatggagccaggggaaatatgacagctcatttcatgggaatagcaattagactgacagctgacttctcaacaatcagaaaataatgaaatgatcttcaatttgattattgttaacttagcattctatactcagcaaaaatatttataaaggatgagagtaaaatagagacattttcaggcaaacattgagataattcttcatcagcaggtcctcactaagggaaattcagtaaaaagcagaaggaaaattatcccaagtagaaggtctgtgatgggtgaaagaatgaaaagtaaagatgatggtaaacatgtggacaaatgcaaataaacactgaagtataaaataatcacaatcattgctagtgggatttgaaaaagcaatggagacttgaaatacaagataacattagcatatgagttttaagttattgagttatctaaaagaagggtaaaggaatttttttttcaaattttagacttttgtaagtaaattatgcatattgttatttctgaagtagccattaaaaaatagaaacagagggcacaatgtcctaacttacacactagcagaggggggcaacagaatgataataagagatatataacttccaagccaccaaaggataaaatggggttaaactccatcaatcaaattgaaggcaggaaagaagaggaaaaataaagaagcattgaaaaattagagtaactcaagggttgaagaaaagtcataatgtaaattagaaaatacttagaactgaatgatagaaatatagctataaaagttgtgagatagaactaaagcagaacttaaagggagcagtatggccttgaattttttttattaaaaagcaagttaaaatttaatgatttaaacatctaattaaagaagttagaaaaccaacaacaaattaagcctaatgaaagtaggtataatctacataagatcataaattgataaaatagaaaacagaaggtgaggcccagcactttgagaggctgacgcctcactcgaggtcaggagtttgagaccagcctggccaacatggcaaaacctcatctctactaaaaatacacatacaaaaaaaattagccaggtatggtggtgggcacctgtaatcccagctcgggaggctgaggcaggagaattgcttgaaactgggaggtggaggtagcagtgagccgagatcgcaccactgcactccagcctggacaacagagggagactctgtttaataataaaaaaagaaggaaagaaagaaaaggaaagaaagaaagaaagagaaagaaaaaaacagagaatatcaatacaactaaaacttggttttttgaagacaaaattctgtgagaactgaagaagaaaatttttttaaaaggctcaagtgaataatattaagaatgaatagaggggaccatgcgcagtggctcacacctgtaatcccagcactttgggaggccgaggcgggcagatcacttgatgtcaggtgttcaagaccagcctggccaacatgttgaaaccctgtctctactaaaaatacaaaattagctgggcgtggtggtgtgcacctgtaatctcagctactcaggaggcggaggtgggagaattgcttgaacccggaaggcagaggttgcagtgagctgacatcatgccattgcactccggcctgggcgacagagtaagactccatctcaaaaaaaaaaaaaaaaaaaaaaaaaaaaatatatatatatatatatatatatatatatattgcaaaacttatttaagaaaaattagaaagactgaaagatgtatatttttaaaaattgaatcaataactaaaaatctactctcccccagaaaatttttaaaaaggtttctaaggtgagatctaccaaagctacctgatacaaactgttctaggaaatgtaaaacgaggaaatacttccacatcattttatgcaattagtatataatctttacatcaaaactggtgagaatagtacaagacaagaatattttcaaccagtctcataaacctggatacaaaaaccctaaaaatacttgcaaactgaattaccaatgtatatgaaaaagctatatcatgaccaaattatatttatctcagggatacaaggatggcttaatgttagaaagtttattaaaatttttggttaaagatggagggctgaatctcacattagctttttctctctctcaatacctcactaatttgctagtaaagggaatttaaaatggaacaaatccacagagacaggaagaatgagtttgtatacagcaacaataaaattaaggggtctagaaccagctctggtttcagctccaacatgtaaaaaacttggaaatcatcatgcctgtccctacagtaagaaggtagtgtaaactaaaaatagattatttttcctagacccatcagagaattgaagtcacagggcaaattactaccctgaaatctggagagacagggagatccaaagagattcagcacctgagatgtgcttacctagaataaaagctggtgacagccataagtggtaggaccacttacttgactagtggttttgacaagttgctggaaactgagtgaggactagcatgagactgagaaatacctgaaggccacacttataggagaagttcacacttttgagggctttccctgcaataacttcaccaagttctcatgataaggatctgagaaaaatccccctgaggatctggctgatgtagggggaagtgtagctattgcgtaacccctagatacttcttcataacaaaagtctattcttgggttccgggatccttcatcataaagtagtactgaaactttatcccacctggagaagggatttccactccgctccaggctttccgtatcacctaaagggaaaaaaacagtaaatagggaacaggcttaagggaaatagattggaaatgctgcaatcaggaaggggagtagggagatgagttaggctcctgaaggaaggatggaaccatttgtgtaggctacaacccccgagacccaggcacactcaaagactgataattaatcagaagattatagactgattcccttcccccacaccctacccaatctctcatatcctggtactaagatattaggattgtggcaccatctttgtggaagactgggttaggtctgaaatactattactggtgaaatgaattatttcacacagtttgtggacagagtatttgatacaagaaacttttttttgagacagggtctcactttattacccaggctgaagtgcagtggtgccatcacagctcactgcagcttcgaactcctgggcttaagcgatcctcctgcttcagcctcccaagtagctagagctacagcatgcgccaccatgctcggctgatttttgtactttttgtagaggtagggttttggcattttgcccaggctagtctcaaactcctgggctcaagtgatctgcccaccttggcctcccaaagtgctgggattataggcacaagccactgtgcccagccttgatataagaaacttatgttgaggatgtggaccagtttatagtatttttcaacaggtagccagcccatcaaattatgagtgggaattggaaaaggaccagttcaatacctatgcgtagaaactgggagaaaatgacgaaagagaaaggaacataatcaaagagcaaatggcaaagtttacccaaggaaacactggaagtattataaatatcatgatggtgtatagatatcatactatcataatgggtcagagggcataatgaagaaatataagagctcaaagaagacaattaagataatattttaaccaagtttgtaaatctcagaacaaaatagaaaagaaaaataaattacaaagccacatgagaagcaaacaaataaacaaacctcacagctaaaaaaatagatacactgtgaaaaagctcaagaaaatcacaccaaacaaaatggaagagagcaaatagcaccgtaattatagagagaactacagcctataaggtaggtaaagctggtgtgagaaatccttcatctcaccccaaataaagaaatccttcatctcaccccaaatagaaacccttcatctcaccccaaataaataaattctgtataaaatgtaacagaaataagataggtatagcaacattcagtcaagaaaggagatcatgagtaccagggacaaaaagggaaggcaaatttagatcaatgaccctgagctgaagctgaaccacctaaggagggtatggcacttcggtatatactagcagtaataatgaaagggagctctggggaccccgggggggaaccttttgggggttcacaaagtcaaaactattttcacaataataccgagattttatttgaatttattgatttctttattaagtacatagtgcagttttcctggggctatgatattacaacaggttgaatatagaaggagatatgagaatccagccagatttgtaaaaatgtaaaacaatgcaattaaatgttttgcatatttgaatatatacttatttttcactaaaagtatgttatttatgtaacatgtaacatgttttcagtattattttaaatgaattaacaaattaatatttaaaaattttatcacttttaagttctattatggcaaatattgatagatataacccacctaaacaaaagttctttaggatgttcaaaataatttatttttatgttaaaattaacatatagtaaaactgagtttgttggcatgcagtttgaagaattttagcacttgcatatgttcatgtaaccaccaccacaaacagaataaagaacagttctattacactcaaaatcctttgtgctgttccattgtcacaccttaccccaaccctaagccctgacaactgatttgctctccatcactatagttacaactttttgagaatgtcatataaatggaattatacaatatgtcaccttttgagactttcttctttcccttagcatgatgcctttgagatacaatcaagttgtagggtgaatccatagttcctttttatttctgagtgctactacagtttatttatccattcacccattgaagaatatttgggttatttccactttggggctattacaaataaaactactatgaacattcatgtacaggtttcatttgaacatttttccaaggtgaatacacaggagtgggattgccagatcatatggtaagtgtatgtttaatttcctaagaaactccaaatttctttccaaagtggctgtgccattttgcattctgaagagcattgtaagagttccagctgctctgcatccctgctaacaatggttttgtctctttctttctttctttctctctctttctttctttctttctttctttctttctttctttcttttctttctttctttcctgctttcctcccttccttccttccttccttttcttttcttttttcttttcttttctttttttttgagacagagtcttgctctgtcacccaggctggagtgcagtggcatgatcttggctcactgcaacctctgcctcccgggttcaagtgatcctcctgcctcagcctcccgagtagctgggactagaggcatctgccaccacacctggctaatttttgtatttttgtttgtttgtttgtttgttttacagagatggggtttcaccgcgttggccaggctgatctcaaactcctggcctcaagtgatccacccacctcagcctgccaaagtgctgggattacaggcacacctggcctggttttgtcagtatttctaatttaggcatttaaataggtgtgtagtagtatctcatcatggttttaatatgtattttcttaatggctattgatattgataatcattttttcttttctttctttcttttttttttttttgagacagggtctcagtctgtcattcaagctggagtgcagcagtgccatcttggctcactgaaatctctgcctcctgggatttggtgattctcctgcctcagccttctgagtagctgggactacaggcatgtgccaccatgcccagctaatttttgtatatttttattggagggagatgttcttcatgttgcccagactggtctcaaattcctgagttcaagcgatcctcctgcctcagcctcccaaagtgttgggattacaggcgtgagccattgtgtctggcctcatgtgcttattttcatccatatacactctttgttgatgtgattgttgaagtcttttggccattttaaaatggtgcttaaattttctaactgctgagttgtaagagttctttatacatgctggatagaagtcctctgtcagatatgtgatttgaaagtatattatcctgatctgtagcttctcatatccttctctgaacagtgtctttcacagaacaaaagattttggttttgatgaagtccaaattataatctttcttcttttatagatcatgctttttgcgtcatgtcaaaaaattttacctaatcccagattatagagatatttctcctgttttctgctaaaagtttcacactattatattttacatttatatatgttgttgattttgaattaatgtttgcataaggtgtaaagttaaggttgaggttcttttttttgtatatgaaagtacagttgttccaataccattcattcatttgttgaaaatataatcctctcttcattgaattgcctttgcacttttatcaaaaatcaaatgtccatactggtgtggggctatttctgaactctctgttctgcattgatctacatgtgtgtgccttcactaacaccacactctctggactctataacttcatagtaagtcttacagtcaggtagtctcattacttcagctttattcttttaaaaattgttttagctattctcattcttttgtcttttcatataaattttggtatcaccttgtgatatggtttgggtttgtgtccccacccaaatatcatctcaaatttaattctcacatgtcaagggagcaacctgtaatacccacgtgtcaagggagggaggtgactggatcatgggggcggtttcccccatgctgttctcatgatagtgagtgagttctcacaagatctgatggttttacaagtgtttgacagctcttccttcacactctcacactctatcctaccgtcttgtgaagaagggcttgcttccccttccaccgtgattgtaagcttcctgaggcttccccagctatatggaactgtgagtcaatgaaacctctttcctttataaattacccagtctaagggaagttctttatagcaaggtgaaaacagactaatacagtacattgataccacagagagtggggtactgcataaagatactttaaattgtggaagcaactttggaactgggtaacaggcagaggttgaaacagtgtggagggcttagaagaggacaggaagatgtgggaaaatttggagcttcctagagacttgttgaatggttttgaccaaaatgctgatagtgatgaagacaatgacatccaggctgaggtggtcttagatggaaatggggaacttattgggaagaggagtaaaggtcactcatgctatgctttagcaaagaggctggcggcattttgcccctgccctagagatctatggaactttgaacttgagagagattatttaaggtatctgacagcagaaatttctaagcagcaagcagcagagcattcaagatgtgacttggagtattctgaaagcattcagtcttatgtgttcacaaagaggtaatttgaaattggaacttatgtttaaaagggaagcagagtataaaagtttggaaaatttgcagcccgatgatgtagtagaaaagtgaaacccattttctgggaagaaattcaagccagctgcagaaatttgcataagtaatgaggagccaaatgttaatcaccaaggcaatggggaaaatgtttccagggcatgtcagagaccttcgtggcagctccttccatcacagacccagaggcctgggagggaaaaatggtttcctgggcagggcccagggcccctgctgctctgtgcagccttgggacttcgtagcctgcatcccagatgctcagatctagctaaaaggggccaaggtacagcttgagccattgcttcagagggtgcaagccccaagacttggcaccttctgcttggatgtccaggcagaagtctgctgcaggggtggagtgctcatggagaacctctgctagggcagtgtggaaaggaaatatggggttggagcccacacacagagtccccactggggcaatacctagtggagctgtgagaagagggtcaccatcctcctgaccccagaatggtagatccaccaacagcttgtaatgtgtgtctggaaaagacacaggcactcaacaccagctggtgaaggagctgcccaaggccatgggagccgcccccccttgcatcagcatgtcctggatgtgagacatggagtcaaaggggattattctggagtttcaagatttaatgactgcccaactggatttcagacttgcatggggcccctttgttttggccgatttctcccatttggaatgggagcatttatccaatgcctgtacccccattgtatcttggaagtaactattttgcttttgattttacaggatcctaggtggaaggggcttgtctcagatgagactttgaacttggacttttgggttagtgctgaaatgagttaagactttggaggactgttgggaaggcatgattggttttgaaatgtgaggacatgagatttgggaggagccagggctggaattatatggtttggctctgagttcctaccaaaatctcatctcaaattgtaatccccatgtgtggagggaaggacctgtaatacccatgcattgaggaagggaagtgattggatcatgagggcggtttccctcatgctgttctcatgatagtgagtgagttctcacaagatctgatggttttataagtgtttgacagttactccttcacatgttcacactctctcctgctgctttttgaagaagatgcctacttccccatctgccatgattgtaagtttcctgaggtgtctccagccatgcggacctgtacgtcacttaaacctcttttcttgataaattacccagtctcagggaagttctttatagcaatgtgaaaacagactaatataccttgttaatattgaccaaaatattgcttggattttgacaggaattgcattaagtatatacattaacttgggggagaattgacatctttactatgttaaatttaccagttcatgaacctgatatgtccctccatttatttaggtattcactgatttcttccatcagcattttgtagtttttattatacacttttggatttgggactgccatgagttcaaaagaactcatgaaaaaataaagtggtaaactcactgataatttagagtattatgaaatctagtcttctccaaatccagtcttctccaaataaattaagtcttctgtatttattttcaaagtactcaaatagctgctccatgtgttctgtctatgttttatagctgtatttagtgagggagacactgtgcagtttgctcacttcattttacccagaacaaaacccagtaatttttaagtttgagaacgattacattttaggggctgaagttttaatatgctcacagagacaaacaatgaggccataaagcaggaactgagttccatccattaagccatgagccacccttttatacaaagaaaactggtaaagtttcacccacagggccagaaatatagcaagaaagctcaccatttgtttaggacaataaatggaaaaatagtcatgtctaaaagaaagggcatataattaatcatttcaaaatcattagggaaataggcagggattttgaaaatgtgattaaaccaagagagtcaagaaagggtggtgggagaataaaatatggttaaaataaaacacaagaacattctcctgtgctcatgatgaagcaaaaggaactgagtttatctttttgtcttaaacaactaaaaacgatggatgaaatatataaaacaatggttatcaggcattggacatcaggcagcaaaggacactgatccttgaaagaatggaaacaaagtaagccctatgatcatctcagctcactttcaggtcacagcacaggcatggggaatctaactagaatctggcggactccctgagtcaaggagacacaagtgaccaagtactggagacttcacgtacagcatagtgacaatagttagtaatgtttacttgaaatttactaagagagtggatcttaagtgttctaaacacacacacacacacacacacacacggtgaggtgatgaatatgttaaccggctttattacagcgatcattttataacatacacacatatcaaaacatcatgttgttcccatggtgtgaccactctcccactccctccctgcccgcagcgaggaggtgcatgggagggggcagggaaaaattaaaacacaaatttaaaaaaagaataacaacaacagcaacaaaaaccaaaacatcatgttgtacatgctaaatatatacaatttttatttgtcagtcatatttcaataaagctgggggaaaagcaagaaaaaaagcaaattcaagaaagtggacaaagtgatgagattcacaggataggatgtgggtggtgaagagaaagaaagggggtgaaggagagcactctggaaatatgcacagagtccccttgaatctttagctgattgccagtcagcacatgcatgtgggaaaattacccaaggccagggaacggatcacaaaagacgagcatggaggacacgttttggagctcaaatagggctggggctttgggttgagtactcaaagaagtactgcttcagtggagggcaatattagccttaaactgctgctttaatctgttacggaaaaattaaaagtaaaatttcctgccaacccatgaaattctctccatgaatggtagaaaagaaagaaaacagttttgttatattgaatgagcattaaaccagactcttttgcatcacaggcaatctgctaatgagattgcaaaaacaaaaataaccccattcttatgtatgcaatgtatccattataaacatgttcttaagataaatgataaattgttcttatgtaagagaacttgacagcactgtttgctatacattcttttatagttcatcctaagttcacctggtaattggagtagccatctgtggtagttaattgcctttatctgaaggaaatatgaaacttctcatatctctatgacaagcaggtgcttacagcttagagcaaggcacctaggctaaactcccaggatgacagggagatatagggctgctatcttccttgatgtttacatttcaaagagatggcttccagtcccttaagaaaaacattcctgagttataaggctggcaagaggcttatttagtctttaaagagatttacatacatatcaaagggacagaagaaggattcacaaatgagaagtttctcaaggaaatattaccgaaaagggagagagaaaaggtctctttctcttttggcaacaagaaaagttcaattttatttttgtttactcttccagatttcatcttacaaagatcaaaagcaagcttcaaaaggatcaaattctttccaagtaacttaactgcttctcagaaaaagctaataattattaaaagaaatataaaaaatttagtaccaaacaatataaaattcacaatatctactatccaacaaaaaatgatcaggtatgcaaagacacaggaaaatgacccataataaggaaaaaaaaatcaatagcagcagaccccgaaattgcacagatgatataattcatagacaaggacattaaaacaacttgtaaatatatttcagatatgtagaggaaagcataagcatgttaagaagagaaatggaagatataaaaaagatccacattgaatttgtaaagatgaaaatataatgtctatgatataaaatacactggatgggattaacagcagattagacactgcaataaaaaaagattagtgagcatgaggacatggcaataaaaatcatccaaaaaagaacattaacaggaaaaagtctgaaaataaatgaacaggacattagtgagctgtaagatgactgcaaacagccttatatgtgtgtaattcccaggagaggagaaagaggcaggcaaagaaaaattactaggataagtgatggccaaaatttccccaaatatgataaatatataaacccacaaatataagaaactcaacagactctgagcacaagaaatataaagatgtcaaaatcaagttgctcaagaaatagtaataatgaaaaaatcctaaaaggcatcagaaaaaaatacacattatgtacagaggaacaaagacaaaaatgatagtatatttttcatcagaaaccatgtaagctagaaaacaatgaagtggtatatttaaaagaatgaaagaaagtactgtccgcctagaattatctacctagccaaaatactttcaaaaagaaggaaaaatggagacctttgcaggcacacagaggctgaaacaatcatcaccagtggaccagcacaagaaatgctaaaggaagtctttcaggtagaaggaaaataccaggtctacacaaaaaaaatagataaatacctacttaaagcagtgaatctacataaagaaataaagggacagaaaaaggtaattacttagataaatatatattttttcttatttaaaaaatcttgatttcttttagaactcacattaatttagcttttttgtttttttttttttttttttgagatgagtctcgcactgtcccccaggctggagagcaatggcgtgatctcggctcactgcaaccttaagtgattctcctgcctcagcctcccgagtagctgggattacaggcgcctgccaccacgcccagctaattttttgtatttttagtagagacggggtttcactatgttggccaggctggtctcgaactcctgaccttgtgatccacctgcctcggcctcccaaagtgctgggattacaggcgtgagccatcgtgcctggtcagcatgtttattaaataataaaaatgagggggaaagtcattagtcatttaaattcatgcaaaatttaggagtggagtttaatatgtaaagcataaactcatttctattttaaagttttaattcattaaacataaatatttgccacatgccataatctatgctagataccaagagtacaaatatgaaaatatatgaatcttgatatctatgaacttatatttcagatactaattatcttcagtgaaaataagattatttcatatttttcctttatatttcctgttgtatcttaattaaaaaaatcctcttgattttaaaataaagaaatcataaaggagattagaaagcattttgggctgaatgaaaatgaaactatgacatatcaaaaattgagggtgacaactaaagcagtgcttagaggaaattttgttatggtcaatagtactttattttttaaattattattatactttaagttctagggtacatgtgcacaacgtgcagatttgttacacaggtatacatgtgccattttggtttgctacaccaatcaactggtcatttacattaggtatatctcctaatgctattcctcccccaaccccccaccccacgacaagccccagtgtgtgatgttccctgccctgtgtccaagtgttctcattgttcaattcccacctaagagtgagaacatgtggtgttcggttttctgtccttgtgatagtttgctgacaatgatggtttccagcttcatccatgtccctgcaaaggacatgaactcatccttttttatggctgcatagtattccatggtgtatatgtgccacattttctttatccagtctatcactgatggacatttgggttggttccaagtctttgctattgtgaatagtgccacaataaacatacgtgtgcatgtgtctttatagcagcatgatttataatcctttgggaatatacccagttatgggatggctgggtcaaatggtatttctagttctagatccttgaggaatcgccacactatcttacacaatggttgaactaatttacactcccaccaacagtgtaaaagcattcctatttcttcacatcccttagaggaaatcttatagcattaaacacttacatcagaaaagaagaaaggtctcaaataaatgacctaagcttccatcttaggaaaccagaaaaaaagaagcaagtcaaacatacattaaacggaaggatagaaacaaacagtagggcagaaatcactataatatgaaatagaaaaacaacaaggaaaaaaaatcattgaaaccaaaagtagattctttgaaaaaatcaatacaattcatatatatctatttagactaatcagaaaaaaagagtaaagtgcaatttactggtattcagtaatgaaataggggaacatcactatagatcctagagatgctaaaaggaaaatgaaggcatattatgaataacatgctgtcaataaatccagcaacatggataaaatgaacaaataatctgaaagatctaaactacaaaagctcactctgaggaaacagataatctgaacagccccaatactaaaaaagaaattgaatttttatttacaaaccttctcaaactcatgtcacagatggcttcactaataaattctaccaaacatttatgaaaaaaaccccacaaattctacataaatgcttccagaacataaaagaggatggaatgaagtgagcacttcctaactaatggtatgtggccagcattactctaatacccaaatgagacaaaaaatttaaaaacaaaaactatggatcactatccttcatgaacatagatgcaaaaattcttaacaaaatttgagtaaatcatcaaatacattatgaacaaatgatttaatccaagcataccaggagggtgtgacattaaaaaaccaatcaacataattcaccatattaaaagattaaaaaaaaaacaagccatatggcatttcaacagattcaggaaaagcatttcacgacatccaacatccttcataataaaaaacatctcagcaaactaggaaacaaaaatgagaacttcttcaacccattatagaacatccagaaaaaatctacacgtagtatcatatttatggtgaaagcatatttttgctctgctcccaagatcaggaacaaaggaagaatatgggctctccacttatattcattattctactagaggctctagctagtgcaataaagcaagacaaagaaataaaaggtatacagagtggaaaggaagaagtaaaactctctttatagtcacatgacatgacagtgtatgtaaagaatcctaaggaattcacaaaagaagctgctaggactcttaaaggagtttagcaatattgtagtaaacaagatcaatgcacaaagatcaattgcatttttatatactagttacgaattatcagattccattaaaaaatctatgccatttactatagcttaaaatatataaaaacctagagataaaaatctaacaaaatgtgtgtaatatctatgcactgaaaactacaaaacattgctgaaagaaattacagaagacctaaataaattgagaggtgtaccatgatcatggagctgaagactgaatattgttagcatgtcaattgtctccagataggtctatagattcaatgcaattctaaccaaaatcccatcaaatttgtttgtagaaattgacaagctgattttagaatccatacaccaattccaggaacttagaatagtcaaatataattttgaaaaaggagaataacactggaatacttataattgacttcaagacttgttataaagctacagtgatcaatacagtgtggtcctggcatgaatataggtaaatagatcaatggaatagaatagagagttcaaatataggcccacagaattgattttttacaagaatggaaaggcaatttattagataagtgataatattttcaacaaatggtgctcaactgattaaatattcatatggaaaaaagtaaattttgatgcatgtctttttccatattaaaaaattaactcaggccaggcatggtggctcatgcctgtaataccagcactttgggaggctgaggcaggcggatcacctgaggtcaggagttcgagaccagcctgaccaacatggagaaaccctgtctctagtaaaaatacaaaattagctgagcatggtggtgcatgcctgtagtcctagctactgggcaggctgaggcaggagaatcgcttgaacctggggggcggagtttgcggtgagccgagattgtgccattgcactccagcctgggcaacaagagtgaaattctgtctcaaaaaataaataaataaataaataaataacaaaatttaaaaaataaaaaaaaaactcaaaatggtcataggcttaaatgaaaaaaacaaaagctataaaaccgctggaagaaaacatagtagaagattttttttaactttgagttaggcacatatttcttatatgtaacaccaaaagcagagtccataaaggaataaactaataaattagattaaatcttccgtttttagaaagacacagttaagagaatgaaaatacaagccactggctagtataaaatatttaaaaatctatactcaatataaaggatttgtatcaaaactatataaagaactttcaaatttgaatagactagtaaccattaaataagtcagattgttagaaaataaaaatcccctcgaagaaggccgaaacgacttcatcatagttttttgtttgtttgttttgttatttatttatttatttatttatttttagcgaatcttcaaaaaatatctaacctcaactttcttggtgaatagaaaaatgttacatatttttgaggctaaaatgatcttgatgcccaaacctgactgagacagcacatgaaaagtttatgggccaatcttgagtgtaagcataagtgaaaaatcctagctaaaatacaagcagatttattccctaatgaatgttttttaaaatatataagcaagtaaggtttatttcaagagtggcttaattagagaatctgctaatgtaattcaccacattaatagataaaaaggagagaaaccatatgattatgttagctgtagaaaagcaactacaattcaacattcattcataatttaaaaacaaacaacaaaacagacacaaaagtgaaaaaggatagctactccaaacccacggcaaacagtgccattattttccaacatgatactgaaagttctaacgaatgcactaaaatgacaaaaagaaaacaaaaagaaaaagaatataaaaatataattcacagatgatatgtttatgtataaaatctgtgagaatctataaacaaactattagaataagagaattcaacaaggttgctagatacaagaatttcatatagtatcattagaattcctacatagtagcaattagcacataaaatgtaattgttaaagaaggatctcatttgcagtagaataaaactctataaggtatctaggaataagtctaaaagtaatattttacttaatatattaaaatgatctcatctaaaatgtatttgatctatttaattatttatactttaatctccattcaatcaaaattttgagttcgcaccatgtgccaagtactgttgttaggagatgtagtgataaatgagacaaagttcccaccctcatgaaacttatattctagtgagagaaggggataagaaataaaatgagaaaaatatacagcattgtagaaaaataaatcaagtttaaaaatggaggacaaagaggggtggtattttagagtaagtggtagaaggaaaggagaagacatataatagagacccaagtgaagtgggggagcttgcaaaggtgggggtaagggggggatagcttttcaggcagagaaagcagcaagggcaaaggccctgaggtggagagagcatggcaggtctaaaaacagcaacatgaagtcactgtggctagaggagtgagtgaggtggagaatggtggaagatgaggttacagagttatgcatggaacagattatagggccttccttgtaagctatcataaggacataagaagtatagattttcatttgagtaagatgggaatgccactggagggttttgaacagaggagtaacacaatttgatttgtgttacaaaaggatcattttgacttttgtgttgtgaatagaatatagggtggtaaggctacgtagactcagggaggccagttaggacaatattgcagcaacaaagtgagagatcatggtgtctgggaacagtgtggcagtggtagagaaggtgagaagtggttcagttctgaatatgttccgaggagaaagcaaagggatttgctgatacagtcgtccctctatatctgctatgggggattcgttccagctctcccctcatcaaaatctgtggaagctccagtcttaatggcgtagtatttgtatataacatacacacgtcctcccgtatactttaaatcatctctagactataatatctaatactatgtaaatgccatgtaatagttgttgtactgtgttttttattttatttgtattttaattgttttttacccccttgaatattttcaatctgaggttggttaatttgcggataagggctgactgtagtttcaaggtattctggcttgagtgattgcaaggatagttttccatcaactgagatggagcatgctaggggtggaacaagtttttaaggaaaagttaaggattcagttttcaacatgttaagtttgaggcatctgttagacatccaagttgagatgtcaagaaagcagttagatatatgatctagaatttaggggagaaattaggtctaaacaggtaaatttagaagccatcagcttcttgatggtaattaaaaccaggagactggataaagtaatcttaggaacgaacatagaaaagaaaagacaaataaggactgagcaccctgagtagttagttaaacagcatgtgaaccattttgttcttgatcacttagtttttttggatccaagtgatggatcctgttctttctcctcttaagcttggtattttctacatttgccaatgtcagtgtgttttcctatagtttatgtgggaaacaccactaagtctcttgtttctgccatccttagcttctcacaactaggtcagttaatttcctcacctgtagtcagtccagtcccagtttttaaaacaattcatattggaagcatgaagaatttcagaaatatctagatcttcttcagcagggcttaggatcacattgctgtctttattggctaggaatagagctcccctctccaggactctgcatttccattaacagaagtgaagagcaagccttgatcacccacccatttcctccccatcaacaatcacagaggtgccatgactatctgccttaagatcacagaactaagtcctttatacctttcaactttgtttatgtcagtcatgacaagaaccctggaactccttggccactacctgtgtatctcatgttctaatcctcatacaactttgtatatttccctattcttacctcttagccctctccagatcctgaaatccttctattgtgtcctctaaaaccacagtcctggtttgcccaggacaatttcagtttacacatgatgtaccactgtcctgcctctgtcattctctagagtgtccaagactggatgataaattatacagtcccctcatctagaacccaaagtcatcagcgaaatcccctgtatccattccctgtttgctgaatgctcccctcaccttcttgagttaactgaaatctggatccccccaaggactttacagccctttcaagcagtgtttttttttatcccatatcctgaggcccctcattgctgcttccagatcattctccctttctcctccctaaaaatccccaatctttgaattccctgtcacggagtatattacccaccatcctaccttgctgttatttatagaacatcagtgcccctccagtttctcaaaagttttggcttctgtctcactgtcactctctccaattaatcttgtcttaattctttatgatcctaatatctcaatacctgatccttccaacatctcatcctctcaattccttgaaactccccgcttccagtttcatcctccacctagtcgcagctccttgcctctctcttgtccttattaataactccttctcctctcctccaaccccagagctgaatatggctggggaaaaacacaaaatgatactctcactttaaattcaagcccacaaacctcaagtgggcacttaatgttgccaggaaatcacataatattatcctagtccatttactctgctggtttcctagacaactattttataccttctcctctcccttcaagcctctaatgcctcagcacacatcctcattctcagcccacgaccttgcttccggtttcactgagaaaacagaggcaatcagaaaacaaagcccacaaatttctaccaccatatcttttcacctacctaaatctgtgtgtgtactctaccctttctcccattatgatggatgaaccgtctctgctcctagctaggtcaaccccactacttgttcactagatcctatccccttctggcagtcccctcctctcttgcccttgtagtataaatcccacccccacccctccaaccctggccgccaacaggttatttctcatcagatttaaccatgctatttttgctcccactcaaaaatttaaaacatcttttgagctaccatcccttgctcactatttagcccctatctccgctcccctttacagcaaaattactcgctagaattttctatattcaatctctgccatttctctttgcccattttttgaacgttttattttgaaataattataaaccacatgaagttgcaaaaatagtacagagaggccctttgtaaactttacccagatttccccaatagtcacatcctacaaactacagtatttcaaatccaggaaattgatattggtacaatgtgtgtgaataattctatgccattttatcatatatgtaggtttgtgtaacaaccatagcaatcaagatacagaactgatccattaccacaaagaactccttcctgctacccctttatagccacacatactcccctctcacccaccttccctattccctggcaaccactaatctgctctccatctctgtaattttctcaaatagaaaatatgatataaatggaatcctataatatgtgaccttttgagattgcctttttgcactcactgtaatatccttgacatccatttgttaatgtatgtgtctatcatttgttttctttctcccactttccttgtgttttgtacaataaggggttgggaagcaatgtacaggggcagcagcggcatccatgggctagaagaggcagtgacactgtatgcctcctacagtcattcaggacaatgtcaggcgtgccgtggattttttccatcagctaatcacacacaccccatggtgctgaggcaaaggcaaaggttgagcagttcttggttgaggacactctacttggtattctctaggatgcaatggtccatgtgcagcaccggaaaggcacaggaggttgaggccggcaaggtggggcagcatggtggttggagcattctgtagcatcagcagcccctgggaggttttcttcaccagcagcagacgcccaataccaccaaccagtgtgttctccccacccccgcaccgactgtttgctgggcctctgggggactacctggcatagggtcctccagaatgtgtacacgcaggtggctacatggaagtctgcccagcttagcagtttctgatgggtacatgtacaccataaggttgcggtctctgctggaccccaggatactggctaggcactgcctgccatgaagtccatggtgtacaccttgaggaacttggcgtcctgggacatgtggctcagtatcttgctctcctcttggtagtgacatctgcagccagatgaagttcttcacgctactcatctggtggatgtatagctggtgtccaccaaggccatgcctgtcggctcactggccctcaggatccacaggaagctcttctggctgatgactgacaccaggtggccattgcagggcacaggacagtcatgggccccctcaatttcttcccatacaggatctggaacttgttcctgaccatatagtaaatgtatgtttagttttatttaggaaactgcaacactactttccataacagttcagtaccagcctggccaaaaggtgaaaccccatctctaataaaaatacaaaaattagccaggtgtggtggtgcatgcctgtaatcccagctgctctggaggctgaggtaggagaattgcctgaacctgggaggtggaggttgcagtgagccaagattgcagcactgtactccagcctgggcaacagagtgagactccatcatcaaaaaaaaaaaaaaaaaaaaaaaaaaaagaagaaagaaaaaagaaaagtaaattcatcagtaaacaaaaagacaaaagttcaggccttcaccaagcttacactagggaagggtggaagtacagacagatgagtaataagataaataagaatattacatggtatatgtaggaggtacatgctatgaaaaaaaataagctgtgaagatgtacataaggagatctggagagttataaattaaaatagtgtactcagagaaggccttgagggaaagtgacacttgaaaatgtgacctatgagaaagcacttgcaggaagtgaaagttcctggaggtacctggagaaagaggattccaggtcaagggaaagcaagtgggagagctcttggatggaagcatgctggcgtgactggaaacagctggtgtggtggaaacagtatgagcgaggaagctagcagttgatgatgaggtcagggaactaacaggggcccgatcatgtacagccagtggaaggactttgacttttgctcctgcttgagccatggcttgagagccatgggagggtttcataaaaaggatggtagaatctgacttctcttgtaaaaggattgcccaggttactatgttaagcaggaaggcaaagatagaaggagaaacagcagttaggaggtgatttcagcaatgcaggcagatgagagcatggtagcttggaccaaggtgataataatgacagtgatcagaaggagtcatattgtgcatttattttcaaagtagcacatcgggatttgctgatggattggaaaaaggtgttagaaaagtcaagaatgacctctcttgtggccttagaaactgggaataatgaaggacaagcgagtctggggagggtagagataagaagtgtcatttttaacatattaaaatttgaaatatgtactaggtatacaagtgtagagatattaaataggcaactagatgtacaagttgtaatttagagaagaggtttggccagagatataaatttgagagttgatagtagatggtgtttaaagccatcagatcagatgaaatgaccaagggagagaggagagatgaagacaagactgattcctcgagcactcccaccttaggagatcaggaatccacggaggaactcataagaaaactaagaaagtagccatgagataggagaaaatccagaacagtgtcctggaaacaagtgaagaaaaatgtttcaagaagaagagagagatcagctgagttaaattctactgatgggttaaataaaatgagaacaatattacatttggcaatgtggaagtcactggtgtctttgacgagatccattttggtagagtcatggaagatgaaagcttgataagagtgcatttaaaagaaaatggaaaagagggaacttctgattgtgtacaagatggaatgaatgcactcatccctattcctcctgctaagaaaaaccctggagattatatgtaaaacaaacacgatgattctgaatgatgaagagaaggcagaccaaccagggaccttggaacctgaggaatggcacagtgcttgagtgctatcagtggaggcctaatggagagtttggattttcaccctttcccaataggaatgaggtgcctctcctgtcccatggtaaatacatggtcttccatctccaactggaaataacatgatggtccccttcctggcagggtatctgagaaggccagttaaaacagaagatttaaataagatccagagtctcattgcataacacctaatatgtccaggatacaaacaaaaatcacttgtcataacaagaaccagaagaatctcaaatttaaaaaaatcaacagccatcaaaacctatgtgacacagatgttgggattatattacaaggattttaaagcatccaacataagaacgcttcaaagagcaattatgaccagacttgagtgaaaaaatagaatgatgagtgaaataaatagaaaaatgagtgaaaaaatagaaaatttcagcaaagaagtgatataaaggagaaccaatcggaaagtttataaccaaaaaatacaataactaaactttgaaaactcattggatgggctcaacagcagaatggagaatatggaggaaacaatgatagaactagatgataagacagtagaaataacctagtttgaacaacagacagaaatagactgggaaaaaaaaaaaaaagatgaacagagcctgtggaactataacaacagatatagcattcatgttacaggagacccagcaggagagaagaaaaaagtgtggtgctgaaaatgtatttgaagaaatcatgacaaaaattttccaaaatttgagaaaagacaacttacagattcaataactgaccaaacccctagcagaataaaccccaagaaacccaggccaagatacagagttttctgtacctggaacagtgaatggcacacagtaagtgttcagcacataaataaatgcatatatcacttaactcaggttatggtgtcccagtactattggcagtggccacttaaatctacataggcttggagtcataaagatttattttaaattttaattattttatctgcattatattttagagttaacttatctactcttgtatctattgttagattacagaggttgccaggataacagatcaacaataacaaaaaatagaatatattcttgtcaaactttatccagtttagtaaatcactattctacataatctaaagggtattcaaagtgactacaaaatggatttaaaaatgagataatctggtcaagaaaaaaataaaatggaacagtatgagcaaggaagagagtagttggtgatgaggtcagagaactaacagggggcccgatcatgcatagctgtgtacatggaagtcttaaggtaaggactttgacttttgctcttgcttgagccatggcttgggagccacgggagggtttcagataggaaaaataaaatgaaactagaggtgagtttaatataaaatgcaatctgtaaaatcctgttcacttgccgggggtggggaataccaaatatttggctccaagctttctagcagccaatgcaaaaaaagaaataaagggcatgattcctacggagagcaaagcctcttcctagagccatgttccctgctctaccagtagatggcgcacattccatgtgatgaggattaaggagcaaactcttcaaggcagggcttctaaactgagcctaaaattaatatcaatcattctttctgaactacgtgcctggctatttaattcaccatatagttcttagtgcagctttgggagaatttgctattatctcctttaaagataaggagacaggattacaggtaaaactggctcaagcccagatttgagtctctactctttctattgcaccaggcaggcaacttgctattatttggaaaacctaaggcaggttttactctaattggtgggactctttgactgggaggctttcttagtgccactgccacaagatgcagtaagagtcggaggcgaatttggggttctgacataaagtagctgtttcagatcagggaaatcgtttaatccgcgtgactcaacttcctcttctgccaaatgggaatgacaaaatctgctccacttaactctggaagtggtgtgaggatagcagagggaaatagatgtgaaaacacaaagtagaaaacattctataggaatgctgtattaaacccaagatttatcgaattcctacaatgagctgggtgctgcggtagtcctgtcaggtggtattattcaaagtgtggtccatggcccactgctggtccacaaactgtttgttgttggtttgaatcgaatgggataaaatggaaagaaagtgttccaaaaccttaacaatttgtcagagtaattttatgtctgttgaatataatcatgaaagagttgcacttgtattttgtgtttttgtttttatttcatttttctagtaatttattggtattgtattttataaaagtattgatacacgatatattttagggaaaatgagtttttcctatgaatagtttgaaaagcactgctgtaaggaatataaagtaaaatataggacatgggcctgccatcaaggagcttgcaggctagttggtgaacaggtagcagagtggttcagaaacgccactaccactattccactgtgctttaactcctctatggaacagaagtctatacagagctgaggaacttacaagtgaaagatcttcaaatcctcaaaaacattccctaaacaaaccctcatatctgctgccatagaatagtagcaactctagctagacttggacttctctcacatggagggcagcctgacatgggatttttttttttttgagacagagtctcactctactgcccaggctggagtgcagtggtgtgatctcggctcactgcaacctccgactcccgggttcaagcagttcttctgcctcagcctcccaagtagctgggactacaggcgtgcaccaccatgcctggctaatttttttgtatttttagtagagacgggggtttcaccatgttggcctggctggtctcgaactcctgacttcaaatgatccacctgtctcggcctccctaaatgctgggattataggcatgagccatcacacctggcctgacgtggaatttttaaaaagtaaaatttctcatgaaggtcacttgtcaaaaattatccttcaatcaaacactattcttgtttttctatattacttttaaagatatataattgaatgggtaatacacatccatggcacaaaattgagaaggtgcatagctctacatccacatactgtattgtagagaattttgcatataagtacataaaaaagttttctcattttttttttttgagatgaggtctcactttgttgctcaggaaggagtgcagtggtgcaatcaaggctcactgcagctttgaactcccagattcaagtgatcctcccatctcagcttcctgagtaactgggaccacaggtgtgatgccacacctgactaatgtttgtattatttctagagacaagttctcactacgttgcccaggctggtcttgaacccctgggctcaagcgatcctcccaccttggcctcccaaagtgctgtgactattggtgtgagccactgcatccggcctttcattctttttctttttttttttttccattggagagatgcaccattatttatttgatcagtcccctattgagggacatctggttgcttcccagtttttattattacaaacaatgctacagtgaataacctcgttcatataacattttacacccatgcaaacataactgaaggaaatatttctggaaattaaattttgggatcaaagtctcatatattcttaatttttatagttattgcaaaattgccctcaattgactaattgcactcccaccaacaatttatgagaggacttaccctcccacccctgctttgtcaacacagtgtattattattactactatcattattattattatttgaagcagtctcattctgtcgcccaggctggagtgcagtggtgcgaccttggctcactgccacctccgcctcctgggttcaggtgattctcctgcctcagccaccggagtagctaggattataggcatgcaccaccacacccacctaatttttgtattttcagtagagatagggtttcttcatgttggccaggctggcttcaaaatcctgggctcaagtgatctgcccaccttggcctcccaaagtgctgggattacaggcatgagccactgtgcccggccaacacaatctattataaatatttaaaactttgccagtggtatctcatggtagctttcattagcatttctccagttatgaggttggctatccatttttggtatagaagccatttgttaattttgataccctgctctccaggcacagggcaattacaaatgacttcagatcactttatcatcagcatttcctaacctactgttttgatagatcccctgagctagagaactttgttcattttcttttattctgccccattttttgttctagaactatcccaggcatttcttaggcactcgggaaattttactttaaaatcagtatttctagcggctagcacaatggctagcataatagtaagggctcaaaaaatgtgaaacaaataaataagaaccatacaagaaacattcacttaccactctacatggctacgtactcatctaactgtctctatttgcaatgccaattttaaaatgaaagttaaagctgcatttagacatgatagtttagatgtcactgtggtctattgttctaaagctttttcttttgcaatattaagtctgaagtgctaccttttgttatacagagaaattccgtttttttttaataagctttaagatcacaatgtatttactctttgctctgtaagacctgaaatggctcttgacctgttaacagtttgttgaccatcatgggaggtggggtgggaacatcttttcaattttgtccagggtagggggaggagagcaaaggactcattatgttgatctatcttcactctcttggccaaacccactcacttccatgggcacaaacacatgggacacctggctggatttctgtagagagtggtctgagccatgggaaagaaaacaagttaacagtcagaatctgtacctcttgattgaactgttaattttgccacattagcaccacactctcaccacttcgcttgggaaggtattgtacagacatttatactcaccacacaaatagcttccgaaaaacttggggatccaaaggctgaaggagccttgttcattatcatcattatcattatcaatagtaatacaagctagcatttattgagtgcttaatctgttctaactgttctacacctgttaatacatttactcctattatcccattttataggtaagaaacccgaaacagtgaagttagataacttgaacaaggtgacacagctagtaagcgtctgagtatggttggctttgagcccaggcagtctggctctggagctcactctgttttgttttgcaattcgcaaaagataaaatgttctttttttgaaatgcacattttttggggggagggggagatttcgtcccccaactggagccctccaagctgtcatcggtcagtggcgacaccaagtggtaaactgggtgtactgcagcccttttataactcccaattccccccaattccttgctccctcccaacccctcctactcgctccccagctctcccaaataaacctgtatgtactttaagtaaagccaatatgtttgctctgcagaggcagtttcgtgacatgtctccttccaaccagactgccatccttcaaaccgttttttcctgtatcagaggaagaggtgtccgaggttagtttgtgttttgaatctcatttctcgcctctcaattattttactccattagttatcccctccttttcttgactcttttgtgtgtgtatgtgagacagagtttcgctcttgtttcccaggctggagtgccgtggtgcgatctcggctcactgcaaattctgcctcctgggttcaagttattctcctgcctcagcctcctgagtagctgggattacaggcgccagccaccatgcctagccatgtatttttagtagagatggggtttcatcatgttggccaggctggtctcgaactcctgacctcaagtgatccacctgccttggcctcccaaagtgctgggattacaggcgtgagccactgcacccggcctcttgcctctttattattgatttcaccagtagtttttctgctcgacctacatataagctccagtttcttttacttcaatgacaaaaaaaaaaatcaagcaaacaatcaaacctttccttgaacaattactttagattcaccttttaaaagatgaattccaaaagaggattgccttgctcagaaacctcaattctttctcagtcactttttgaattaggtataaatcttagtccaatattcaggatgctccaaaattgggccccaatttaccttctgggtattatcttccacaattcccctgtacttccttaccctaaacttcaaccacataggactactcacgggtcctcacatataacttcctgcctgctcacctttgccaacggtgttacctccacttggatttacctttattagaggcctgtactgatattttctagttatttgtggctatcccatacaccatgagtgcctgaaggaagggactgaatgttaccagctcagaaagcaaaaaaattttggactgaaaaaataaaaatccggccattcatcaggccggaataacacacagataaaaccagatgcaaatttaacagagaacaatatttctttggcggacatattgcagctgtaaagtggtaacgatgtttttatttcagtgaccaccacttttttattcactgagagactttgttctctaaaatcgtagattatcagaaacttttctgcttgaaatcgtatcagtaagaatgaaacatcccacatgcatctggaggacataagtttctttgacacagagaagcagcctcaatttccaacccaggtgcagagcttcagataaggggtatctggacacaacattccacatctatctttattttgtggttcccaaggaaacacaactctgggttcactttgcagttcagacctgatggtgaccccaaatgacagtactgctttgctttgagcttaccaaaaacactgctttgtttaaaattcacctaaactccactcttctctccaatcctataatgactccatgtttttctgtttgatgaaatgcctaccgtgtgcagtctctcatattgcaatgggtcaaagcctgactatgtcggattacaaatttgtccccggtagccttatgctgattgggctaggataggggtttttaaatccctgaccacttagcttgtccaaagtaggcattccaaattgttcactgcagtagagtaccctggttctagttagattacttggattatatggattccagtctcaggtctgccaagaactaattagctggatcatcttaagtgagtcagtgcaccccatttggcctaagttttctcttctgcaaaacggtgtgctgtttctttcaaacctagggtaagggctttggagtaagttagacctaggttggattcccagttctaccacgtactagtcctgtgacttcagcttttctgagcctctgttttgtaatgattaatatggagataatacagtactaacaactgcagtatagtttttgcagcgttgctggaaacatcaagttggctgttaaaagtatcactacgtttgatcactattcctattcctactattatatgagtttagacaagttacttaacctttctgtgcctgtgtatttttatgagtaaaaatggagaaataaccctcggggttattgtgaacaccaaatgagacgaaaaaagtaaaggggttaggagagtgcctggcacataagaagcagctcaaattatgtgatctaatgttattagtattagatttctactactaattactctgtgggccgaaagctcaggatagacagtttcattctaaggacaaaccttctccccagcaaaaaaaggcactgcaagctggaaatagtgaaacacaatggggcattgcgttttcaaaggcaactgacacgcccagcactgggataggacccgcccgcccagtcctcattaaatatggcagcgagcggggccgacgtactgcggctgcgcaagttgaaactcctcctggcagctcctccccggcgggcctcccctcatctcggctgggtagaggtgccgggtgtgagctcggcgtggcgcgcacgcgcagacgctggctgggctgagccgatactcgcgaggcgccctgtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacaggtaaaggcaaacgggctgtcccttccccaacagtccttggcgggccgctggcccccggcccacccccggagcaccccctaagcgcagcgacacaggggaagcgcaatcccgctggcttggacccccggagatggggcttccccgcgcccggcgttggcagcccggcgcttagaggaggtagacaggctagttccagccagtgctgagcggcgttttcccgggagcccagccctgttctccgagttatggtccctgggttgcccgagcgaagtttccttgcggagcggcgccaagcccgccccgcttttgaatcggagtgtttagccgcctgcgtcccctttcccggactggggtagggtgacttaggctggcaaagctcagccgaggcccggctcttctccctccggctctggacttgccgctggttttgtatgggtcttagcaaagtggagaaactctcggaaaagtagttgctgcgctgttttccttttgccacttaacgcgcgtagctggttctctccagactttcgagccttgctcttgagcgccttgatccacacgggaaaagctttgcctttacattgacgcacgtttcctttgattaacatttcagagcaaatcagttgcctggagttcccagtgaagttgtacctgtgcccgtgcgataacgtcagtggaagctgccccgagtaagtgagggaaatctagaagtttggagcataaaaaaccagcacgaatcaactttacataaacttcatacatttattagcaactgctcgggtttaacttcagggatgttaaatttcgcctagtcccacgggacgatgatcattacttcttaactgcacgcgaaataggagaagaaaaaaggcaaatcaaaacagactgtcccaggtctcagagaagtcatcggagcgctttttcctgctgaattcaccctaggagtttgtgagttcctagttttcttggacttcgcgaacttttccttgtccaaagcactgtcttttctctgttggtgttttgggactggtgtacacattaacccttttgtcattaaagaaggccaacacgattctcaagctagtattagccttcagtgtttgtgctttagcactttcacttaggaggtggaggtgttggttgtataaaagatatggaaataacaatctactttgatgttcaccaggtcaaaaaggtgaagacttttagaaaaaacagattggcttgtatgctaagtagggaagaccagtttattaactgagatcttgtttaaatgggcaagcagagtgttaagcctctaagtcaaactaagtcgtcagacctctcattttttctcccattcctagctcctattttttttttttttttttggtttgagccggctctcgttctgtcgcccaggctggagtgcagtggcacaatcttggctcactgcaacctccgcctccctcccgggttcaagcgattctcctgcctcagccttccgagtagctgggattacaggcgtcacttgtaattatagtgcaccgccatacctggctaatttttgtatttttagtagagacggggtttcaccatgttggccaggctggtctcgaactgacctcaggtgatccgcctgcttcggcctcccaaagtgctgggattacaccgcacccggcccctaactcctttaatatttttgcaaatattgtcctaggactggatttgaagttttaacaacaggaattagctgaattaatttggttttctttaaactggtattccatttttacatttttcttcttctttggttcattttccccctgattataaaagcaatatacgctcactataggaaatttgcaaagggtgggaaagtataatgacacaaggagagagaactactactcaaagggtatcatcactcttcactttttattccgcttccttttttttcccctatacaagatctgtttccaaactttattcataaactttcctctccttctactgatttttaaatgtaaagttgggtattttgggggttggttagggcactggatattaatgttgctcttcagtctccaaagcatgaaacttcaaggtaggaaaggtgcttaacggtgatttcatccagcaactcatcaactgagactcagacctcatttactgaagctctaatgattcatgcagaaatgtatagcactgagtggcaacattaactcactccagatctctctctcttcagagataccttgctgcttagagggaaacttgacactacccatgcctgcatatctttgaaagagaggttcagagaggagcaggagataattttcaagcatttgaagtgtatagtttcttttaggtattcatttttctgtttacattttcaggtttggggctttagccccttggagaaaacagggccacatagctgcctttctatcaagtctccctacaaaactgagaggctctgggaaactcagcctgtgaccccagcgtgggtgaagataggatcaagatggccatgtggcagggtaagaaattagcacttattcttctaactggtttttcctcctactctattctctaccctcacccaaccgttccccacccagccaatggcaggcagccagctgttctttaatttaaccctttgtctttgcagggacaaaacacattagtttaaaaagaagctgctgctagctataagtttaaattatttaaaagtggggttgtaggagaagtaggaaaatgccatgccagcagcatttaaaagaactcccttcatttaaataagtgatcattgggggttatatgccaggagacaggatattttttcccatttgtgtttttcatttgtttctggcaaatttctatcataagattccccaccataaggttggggagacagatgtcactgcctctccagcttcatcttcccaataaaaactttgtgatgtatgcagtttgaaagagcatatttaatgttacagtgtttatatttgatacaatataaacattgagaaggaaaacgcctgttttaataatatgaactacctgagagcaaagctcagtagtatcttagctgatgtattacatctctcatgaacttgtgaattcctaccacatacaaagttatgttttattttgagcggagttgcggtttgtgccctttggagggtttaggagtctccacgggtatgtgggatttttattgttatcaaaagtgagtgtgggtttaagaaatgatagacaaacactaccaaaattggcctgtgacccacaaaaagttaaagaccacttaaatggagtggaatgaaatagcttgaatatctagaaatattcagcaggttggttagttggtggtctaatgtatcttttaaaaatgtttcattgtgttggttgtgactttatgtaggcacacaaatgtaacaagtagtttccatgtataaagattatcaatgagaagacatttatggaaacgggatttggcctgtatgcttcctttgactcacacaatgggcatttatcaagagcagtttggatattcttgcttaaatcctgagacattatttcattcaacaaacgaaatacagagatgaataagttgcaggatgctagaagattccttgtcatctaaagacagacatacaaacaaataattttgccatgttgaataagtgttagaatagagaggtacaaaaagcaagggaagccccgagaaaagcttgatgaagtctgagttttgagctggtctaaaaaaatgagtaggagcaaatgagagaattgcattctgggcagacagagcagcactgtttgggaagttccaagttgctctgtttgcctcatgtgagatgtgtaggggcgcgacctcagatgaagcagggaaggtagttggaggccagataataaagagccttgtatgttctaggaaggattttacactttatcctgaagacaaagattctaaacagggaagtaacataatcagattttgttttagaaagattactttggcagcagtgctgagctggaaatgatgaaaactgggagtcagtcaggaggtttctggaatagtttaggggagagatggtaagggtctgagcagaagcaggggcagtaaggttagaatgggattctagaatgttctgtgactggatgtggcaagaaatgggcctggattaactaccagcttgggtgcctgggggccactggtgccattctctgagatggggagcatgggaggcagctgatgggcatgggggtggtgcactggatttggatgacctgtttgggttgagacacctatgtactgtcaggtcaatgtttcaaagacagttttgaaagtacagaactgatattggcacagatggggatctaaagttttgttcctaatgatgcataaagagcttgtatttttttctctgtagttaatggaaatgtcattactagttaatgatttattttacaataaaaacattttaatgtttaacaactcttaatcaaaatgtcatattttcatagtaaataatgtattttgcaagcccaggccctgaaatcagatgtgcttaaaattacattgaagtgaaacctcatttttccagcattagtgaagaggggagtattctatataagtaagctctttggataactgcagcttatcctttgttttggctaacctctgaagtaaccagcaaagtacgatgatagtttggaagcagtgtggtatgatagttaaatgtgtgggtctgagttctactccattggttctgtcacttggtagctacgaggccttgggcaagtaacttaatctctctgtgtggaagttttctcctttacaaaatggagatagtaatataactcatcccattgctgagtatatagccaaaagaaaggaaatcagtattgaagagagagctgcactcccatgtatattgcagcactactcacaatagccaagataggaaatcaacttaagtgtccatcactggatgaatggataaaaaacatgtgttacatatattcaacaaaatattattcagccataaaaagaatgaaatcctgtcatttgcagcaacatggatggaactggaagtcattatgttaagtaaaataagccaggcacagaaagataaatactgcatattctcactcatatgtgggagttaaaaaatgtggatctcatgaaggtagaaagtcgaatggtggtttccagaggctgggaagggaaggagtttggggaatgaagagaagtgggttaatggttataaacatacagctagagagaaggaaaaagttttagtattcaatagtacagtagggagactacagttaacaataattatatatttcaaaatggcttgaagtaaaaaattggaatgtttctaacacaaagaaaagataaatgttagaggtgatgaatatcccagttaccctgatttgatcattacacattgtatacgtgtatcaaaatatcacatataccccccaaatatgtacagctattatatatcaatttttgaaaagggagaaaagtagaacacctgataggcttggtgtgaagagaaattaagctaatatatgcagagcacttggaacatagtaaatgccatataagtgtatgccattattataatagtaaaacatttagaatattgtgtagcatataataagtgctcagtaaaatttagcaatagccgttattactactatcactattattttcttataacctggggtgggactgggaccttgttctgtggaggtaattttaggttgtccttggaagccctgtcctgtggttgtctgtttgggtctttaagtagaagtttagacttgaaaagattcttagaaaacatctagcagccgggcgcggtggctcacgcctgtaatcccagcactttgtgaggccgaggcgggcggatcacgaggtcaggagatcgagaccatcctggctaacacggtgaaaccccgcctctactaaatatacaaaaagttagtcgggcatggtggcgggtgcctgtagtcccagctactcgggaggctgaggcaggagaatggcgtgaacccaggaggcggagcttgcagtgagccgagatcgtgccactgccctccagcctgggcgacagagccagactccatctcaaaaaacaacaacaaacatctagctcaattcctagaggttaagtgatatgcccaacgtcaaacaggtagtagttgatcctagagctagtattaaaatccaggtcacctaattccctattccagtattctttccgtgggctcatggaagaggcaatgtgtgagtctgttctcagctcaaggaagcttctgagtcagtctgtagagcttgttgaggaaccctaagggctacaggagcccaaatctccttaggttcttggctcattgctgtctggttcctccatggagaatttgatctgaattcccatacctcttaaatggggccaacattattttgacttcacttaatggagccctctaatatattttctggccactttaaacagtgtactgagcataatttaatatttttgataactcagggttatcattaataacctccagccagtttgaggttggagacttgtgttgtcaggtgttgtttatttattccattaacatttattgaacactacttgtgcagcaggcactctgctgggccctaaagacgcaatggtcagtggaaacaagtatggtctctactgtaatggaacttaagaaccaggataaaggtagcacttcaaattaatgaaatgatttatttaacacatatgctgaagtaatttggaaaaaatgacagcataaatttagaagggttaatataatgtttcttaataaaggaggggacatcagaattacctgtagtgctttaaaaaatattcctactcaggtccccattcccccaaattgtgattcagtcttaagacctgagcattacaatcctgttttggaactgctgcaataaatataggttttttgttttttttttttttggagaaggcgatgataaaggaactcaaaaaatatggaagactatatatataatcttggggatagggaagatatttgtgtgcataatatcaaaggtagaataataaggaaaaagattaatataatcagttatatgaaaatttaaaatttctgcacaaaccataaataaagttaatgagaaaactagaaacaattgcagcaagatttattatctgtaacacaaagacttaacagggggataagaaaaaaacaagtattttactagaaaaatgtacaaaggacgagggaaaatgtgcaaaggaaaatacatcaaagaagaaatgcaaatggccagtaaacatgtatctcagtagcagtcaaataaaggggaattagaatggcataccattttctccagtataatttgcaaagattaaaaaggaatgacagaactcactgttggcaaggactcaaggaagcagatgttctcatacacttgtggtgggaatgtcagtttggcaatatttattaaaagctttaaaaaatatgtttaccttctgacccagcaattcattttcttggaatttatcctaaggaagtaattaagggtatgcacaaagatgtatcaataaggatattaattgcagcattttctataatgggaaaaattgaaaacacttgcattttgatgcatccatacaatggaatatggtaattaccaaaaatgataatgtagagttctatttagtaacacagaaataggttcataacataatgttaaacccaggggtcagggagtgggggagcagggaaaagcagattccgaactgttgatacagtcatccctccatgtgctcgggggatttgaagaccccaagtatactaaaatcctagcatactcaggtcctgcagttggccttacagaacctgcatataggaaaatttggccttccatattcatgggtgtcatattctgagattaccgtattttccatctgtgcatttggttgaaaaacatctgcgtgtaagtgaacctgtgcagttcaaacccgtattgttcaagggtcaactgtcattaaaagtatggactctgggcttaaatctgaattcaaatcccagctacacctttatcagctgtgtgctgttgggtatattacttgtcttagtgttccttgatttccccatcagtaaaatagggataaaatagtagctaacctaatagttcctagctagtgtgcccaaagatcacctggtgatctttccaaacttcccaagcctaggcctcactcagccaattaaatctgaatctctggggacgggacagagaacagtatttttgaagttccccaggtgattctaatgtgcaaacaagtttgagaaagccgagcagttgttgaggtgattgttgaagggattaaatgagaaaatcacagtgcctgtcatgtggtaagtactcaatacatggtaactattattattattgttgctatttaaaaattattaatagtatgatcccattttaatttatgtgtttgtgtccatgtatggatagtataaaaaaaagtctgagaggatatatgcaaaagtattttaaaaaagaaattatagttgactttatttttgcttacatgtatctttccacttttctgtaaatatcatggattgttaattttaaaaagtataatttctgaaggaaatatcagatatatgtacccagctttatatgctaaggtatttatagtgaaaaaactgaagacatagttttcatactaggggaatgtaagtatattatgatagttccaaacagtataatatctggccattaaaaataaagactagctgggtgtggtggcttacacctgtaatcccaggaccttcggaggccaaggcaggaggattgcttgagttcaggagttcaagactagcgtgggcaacatagattccatctctactaaaagaaaactttttttttttttttgagacagagttttgctaactagccaggcatggtggtgcacacctgtcgtcccagctactcgggtggctgacatgggatcactggaccccaggagactgaggctgtagtgagctatgatctcgccactgcaccccagcctgggcaacagattgagaccctgtctcaaaaaaaaaaaaaagactgatgctgtggggactccctctgtcacccagcctggagtgcagtggtaggatcttggctcactgtaacctcaaactcccaggctcaagcagtcctcccacctcagcctcctgagtagccgggtctacaggcacgcaccactatacttggctaatttttgtagtgtttgtagagacagggttttgccttgttgcccaggctggtctcgaactcctaagctcaagtgatccacctgccttggcctcccaaagtgcagggattacaggcatgagccatcatgcctggacccatctctctctttttaactcaagtgtgggtttatgtatctctctgtgtttacatgttacatatacacctatgaagtgaagataagtacagaaagaaaggaaatgatccaaagttgttgcactggctgtctccagatgatgggatacagttacttttatcttcctttttttatacttttatttactttcaatttttatgcaataatgtgtataacttttataacagaaaacaagtgatttgaaaatgagatataagagtcagtagactctcaacaagtacctggcagcaaggagcgcagcatgtgtggccccctggacaactgcttagccactctgtgtccccttctacgttccagcaaaagagcaaaagagaagaaaccaggcccctgagggtttggttagaacaggttttttgctattaatacttcctcaagtactcttgtaatttttggctgtctctcccattgactacaaaaaactcttggaagatgtgcaaaagatggcaaattacactgtatctaatgtagaggttgcagaataaggtgaggtggcaaaatatacgtcaggctaagtgtgaaaataaggcagaggaaaatcagaataaaatagttgcaatgagaaactgttcttcaaattgaaaggaagtatatgttttgactgtgcagatttttttttggcacattgcagtgtatttgtaaacactctggtgatttagccaacacatgggaggtggggagcaagagggagcctcacaaagcagtgggtgaattgacgagaaagctttagtgtgaaatctgggtagccatgtggcttgctaattggaccactgtcacctaagagaagccatctggtcctgcttgttgaccgaaacaaaagtaggtaactcttgaaagaaagtcaggttgttagagcaggaataaagaagcaggcagcctccacccccagccccttttcctttatttggcacagtgcctcacctacagcaggtactcaagaagcgaattctttgtcaattaaaataataaagaaataaatttaaaaaatttaaaaagaaatgagttccttgtctctcttcaccttttgcctttccataactcttcagtggggagaaattggtggggaatggattctgatggaagtcattgaatagagggtaaacgaaaacaacctttcaaaaaattattctctaagagtcagttattctttcccaagcacacagttgtggagggagcacaggtcttggagtgcgataacctgaatctgaacccaggtctgccatttggtagccaaggttatttaaactccagaagcctcaattgtcacatccggggtcaagtgtcatgtctggagacagactccctggatttgtatcctggctctgtcactactagccatgtgactttgggcaggttatttaatctctttgtgccttaccttcttcatctgtaaaatggggttaatactaatacctactcaggattattgggaggatgtagtgtagtgagtgaatacaaatgcagcaaagcacttgcacatgctggcctttataatatgtgaaaggttatgataatatttactgcacgtgcttctagatgagagtcagtcatcagaatgcctggtccattatagctgttctgattggattataagttttggcatgaaaaataaaattaggtatattattaaagagatttttaaactggaaggggtcttcagaggtgatctgtttcagatgtataatcttgcaaaggaagaaactgaggcccagtgagacttattttaggccacacagctgtcacatcgtacccaaagccaggactagaccctggggctcctgataatcagtgctgcccagcccgctctttctctgtcaatctgtctacctatttggtcctactgcattgcactgccttccccaggcttgggtatcttacagttttctgttgaatcttagtcttttcctactatgctttactgctaccgtgaaacgtttagttttttttctcccctcaaaaataggttttccattgaggcttccaggatgttttttttccccttcttctcactatgttagcttatgaaataaactataaattcttattatttaaccagaattatgattcagcttcctgtttcatgtaatgctgttctgtgtgtcaagggttgggggaggcaggactagaaagtttcattattggtggctacgaatgccagattctccttcttcttttccttcctaccttctcttaactacccagtatttatagacccatggtcaggccaaagaagctgttgaggagttaatagtatgaagtgtctcccttagtaatgtcatattttgatgattttcaacccaataccattctggcattaggtggcaatttattatatttatttaggatttctgccctgactacatccaggaggaacatagaacaacacagaaattaaaacatagagcaattagaaataaatgcaggacagggaccatccagtggaaatgaaatcgatattactaggcatgtgagatactagacactgaagttttctctttcttttcttctgtgtccctccttcccaaagacaagcacgataagttacatcgttgacatcttctggccaaaaaacgtgttcagatgcaaaagaaaaccctggctctgtctatgctaaatcttctggcccttccactgccctccctttggtctggccttacctgtggccacctgtgactcagcactgaatattcccaggttgaaatcatgatctttcctgtttagctttgagaatggtgagagacaggtaggcaagagagttcctgccatccaaattctcaactctgtcaagctattcttttccttgggtcctgtaccccagtaatacacaataataacagagtttccttatcttacattcctctgtattgaataattgtaccaccatggacccagatgtcaaagcccaaattctaagagacaccatgcatttcttgctcccccttacctgcagtccacccctgctggcctagatcatttcagttggtaacattcctagcaactacctgcttatctttcagccatgagcttttcctgaagcctccccgatcctctggtaaaattggcttctggctctattgtatggtccttgagggcattgactgcacttgttcaatatttttgttctcacatctgctgtgtgccaggcaggcactgtgttgggtggatgctggggttaaagcagtgaatacaaaagtcatgatccctgccctcttaagccttgcagtctcatgggggagttggagtgcaaataaatacacagatattttcttataaagtgttgtgagtactagaaaagtcaagtcctatgaaaaagaatagtagagactgaatttatagagagaagaagggaatgggaggaagtgacaagttcatctgagacctgaaagatgaggaggagttatccacgcaaagagttgggggaacagcatcccaggcagaggagacaaggtggaaatccctgaggtgggaagaatccctgggtcctttcccagcatggtccattgcagcaggaccatagtgaatgaggcataaagggacacatgataaaattggaaaggtgggcaggggacaggccacacagggttttataggccatgttaccaagtaccctaacttggtaacatgaaggccttggagatagattggatatggcagagtgaccagtgaatgaatggggagtgtctcattcatcttctcataccaaatacctggcagagagtgcccagcacatagtatgtgctcattgaatctttctttaatgagtaataactgccttgccttcctatcaggattgccatggagattaaatgagataaagtatgctaaggtgctttgcaaaataattcactagattctatgtagtgatgcttataggttttcactgtcactaggaaccacatccccccaaccccattctctgttaaactagcaaaatctttcaattagttcatcccatgccatgaacatgctgatgtactgtgttcttacatattcaatgtgtctctttgatcaatgcctttaactaattatgggtgagtggaaactcccttatatcacaccattttgtggcactcctggtgttagagataattatgggtagtggtgccaggagcagtatagctttctcttctatgctaaatctacttctaaatctctcaacctataataattcattatttaggagctgggttaatactgaggaatagcattctttgaatttgcgtttggatggggcaaggctaatcatatcaggatgtggttggtaccaattatggcacttggttttctagactgttaaaagacataacaaaatgatcagtgttttgctatttttatgttaaatatctgttccctatttaaactgcaagaacttcagatgattgactgaaaagtccagctccgtgcactgttggtaggcatataagttggtagaatccattagagcgcactttgaaagactttttcaaaatgtaacttgtacaacttttgtcccaatgaatcttctcaaaaggaactgcatgaaggtcacttgttacaaggatcttggttgccttctagttgccatctttttactatcaacagtcttattaatgtacagcatgagagaccagtcatgttaattatgatatttacatactatggaatgctgttcatttcatttaaaagagtaaagtagcctggacgtggtggttcacgcctgtaatcccagcaatttaggaggcttaggtggaaagatcacttgggatcaggagtttgaggctgcagtgattgtgccactgcactccagcctgggtgatagagtaagacagtaaagtagatgtacatatagtgacagggaatggtgtccaagataaatttttaagtgaaaaaaggggtgcagaatggtatatattataggatcccacttgttcaacacaaagaagggaggtattatttaagaattcgtgtatatgtgttcttgcatatgcttagaaaatttctaggatgacgcacaagaaacagttgtcagttaccttggagattagaggtggcaaggctagggattttagttttcacttgacacctttctgtacactgctcgacttgtttacaacaacctgtaaaacctttaaatactaaaatttaaataaaaactttacctcactagattatttcctcgacaatttatactaagaaataaaaggaatattagtggttgaggtgagagatcaggtctgaagcaaaggaggctgactctgataaaaccaagggcctctaaaagctacctctgtggccagaggacttaggagagatgttgctttgttaaagcgtaatgctaagaaaacaagtaagattaaattgggtaaaaattactttattagttttttgatgaaacagttgtaatcatatcattagttttgatctctgggtatattaataactaaacagcatagtaattgtattccagactacaatttaaaaattaaatgtttcaatgtgtagaataatagctgtttttcttgtttgatttgtttaaatgttgcaagtgaatgctaagctacaatttcttgagctttttacttaaggacctgaggaaaaatgcaagtataatcttatgcttgaagtagagaagatataaattacctaatatttacctgataatgtttggattaagttaaatcttcaaattcttaaggccccttctagctcagtctcccccaaaaagagggtttttgtctgagatacaagaagtcaaagggttgtctgtcagaatgtcctcttggtttggcataatgaagagagttccttcacccagttgtggatgttcagagacaagagtcactatcctgtgttaagtgaccctgcttctctaatatttggggttttagccaggagataggtggtagaacacaagacaggttttactttaagatattgattattgtgaaaatggccatactgcccaaggtaatttatagattcaatgccatccccatcaagctaccaatgactttcttcacagaattggaaaaaactactttaaagttcatatggaaccaaaaaagagcccacattgccaagtcattcctaagccaaaagaacaaagctggagacatcacgctacctgacttcaaactatactacaaggctacagtaaccaaaacagtatggtactggtaccaaaacagagatatagaccaatggaacagaacagagccctcagaaataatgccgcatatctacaaccatctgatctttgacaaacctgacgaaaacaagcaatggggaaaggattccctagttaataaatggtgctgggaaaactggctagccatatgtagaaagctgaaactggatcccttccttacaccttatacaaaaattaattcaagatggattaaagacttacatgttagacctaaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaacccccatcagagtgaacaggcaacctacagaatgggagaaaatttttgcaacctactcatctgacaaagggctaatatccagaatctacaatgaactcaaacaaatttacaagaaaacaagcaaccccatcaaaaagtgaccgaaggatatgaacagacacttctcaaaagaaaacatttatgcagccaagaaacacatgaaaaaatgctcatcatcactggccatcagagaaatgcaaatcaaaaccacaatgagataccacctcacaccagttagaatggcaatcattaaaaagtcaggaaacaacaggtgctggaaaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggattataaatcatgctgctataaagacacatgtacacgtatgtttattgcggcactattcacaatagcaaagacttggaaccaacccaagtgtccagcaatgatagaccggattaagaaaatgtgacacatatacacgatgggatactatgcagccataaaaaaggatgagttcatgtcctttgtagggacatggatgaagctggaaaccatcattctcagcaaactatcgcaaggacaaaaaaccaaacactgcatgttctcactcataggtgagaattgaacaatgagaacacttggacgcaggaaggggaacatcacacaccggggcctgtcgtggggtagggggtagaggggagggatagcattaggaggtatacctaatgtaaatgatgagttaatgggtgcaacacaccaacatggcacatgtatacatatgtaacaaacctgcacattgtgcacatgtaccctaaaacttaaaaaaaaagttgcccggtagtctaactttgtcatttattcctttgtgctttgtggtatctcttacatttatcacttcctttaaattccaaagttagcatcttatatacaggtacttagaatgttctacatgaatcttattcagcaatctcttaactcatcaccccaattccagtctcttttttccatctgtcctgcatagttctgaccatgacagctctctgcccaaagcccttcaattgcatcccactgtatatggaatgaagtatgaatcttttagttttgaagccagaattggattcaaatcctagctccaccaactcctagctatgtgatgtgaggcctcattttgtaacgtgttaaatgggaataataacaactgcctcataggtcctggttttcctgggcccctgtttattcctattccatctgattcatactccactctccaaagtgtcctggttttgacaattaaatcatttggtcaataaagggttgttacaaaaagttaatgagacaatgtatataaatataacaggcctggcatgacactttcatgttccctcaaatgtacctggtactttgctgactgaaatcatatctctgacatctccagctacagaagaacctacccatactgcatggtcttcctcagatgctacctcctcaccttcgtctaacttctgtggtagtccacaactctctaaccatgtctctaacataagtttgggttatggttattagtgcacatgttttaacttcctcagagactagcttttggaaggacggtatctgcttctgaatcttcttagtcccacccataatacctaatagtgtcttccacacagaaaatacaaaatcacttatttaaatttagaaagaatatagcattttggctacaggattgtatttcacttacccacgggctttattcaagcctctgctttctcactcccttgaaatgatttcacttgctcgttagggccacagcaagagtactctaataggaaatttctttcacagctggccattaccttgattgattgggggtggcagtgaagaagggattctgggagctatggtcctagaaatacagaataactaaaagcacaggttctagagccagactgcctcagactcaggctctaccagttacaatttcagaatactacccaaccactttatgcctcagttcctatctgctataccattactggaaagattaaatgagataatccatgtaaagcacttttaaaagcacatggtaggctgggtgtggtggctcacacctgtaatcccggcactttgggaggtcaaggcgggtgatcacttgagaccagtttgagaccagcctggccaacatggtgaaactccatctctataaaaatacaaaaactagccaggcgtggtggtgcatgcctgtagtcccagctgcttgggaagctgaggcatgagaattgcttgaacccaggaggcagaagttgcagtagcccagatcatgccactgcactccagcctaggtgacagagcaagactctgtctcaaaaaaaagcacatggtgagtactcataaatgatagctattattattggttcttttctctttcttgacctcagtcaactcagaatactttattatggaatgagaaatgtaagcaacatcctccgtgcagggcagtcaagtacaggctttgatcacatacaaagtccagcccaatcagagctcagcatcttctctgtctttctaggatgtctggtttcttctcccaattcttccctccttcatgcccagtccaagctgaggccagttctaacagcttctgtgatcaccagcaaagataagaatctttctgcctcgttctctagacataacctccaggtccaggttcaactgcaaaccaaactccaggcagctcctcatattctggttcccacaaccagaaaaaatatctcaaaagttgcattatttatgattccagtctttctacccgattccagtctttctacagcctgaaattacatagccttttcctttctcacaattgttcccattactccagtctctaccacctgccctattatgtctttctcaatcaatatcttttttttacctgcccaatgatatatctttctcaatcagtatctttttttttttttttttttttttggcaggaaaatggggctgtgtgtttccctgccccacccaatacacacattcacaaccactgccacctgcacttctctgggcactcaaggtggcacagtagtcagggcatttctggagtctttctgcctctgtatcccccaccccagttttgaactcaataaattgaacaccatttattcttttttttaatcttgattaatgtttaattcaacaagaatgccactcgaattcattctaatttatctgaaatacttgtttgaattaaaatgtcctttcaaattcatatctagtactccaggaagtaaagcaaagaaattttgatggataatgtagggcaatgagtatagaatcttccccacatcaattgatatccacttaatactgtgaactcttccagctaataaaggcttgtcttgactttctgagtatgttttcctttgatggtcttatctaggcaaatttttaaaaattattattatactttaagttttagggtacatgtgcacaatgtgcaggtttgttacatatgtatacatgtgccatgttggtgtgctgcacctattaactcatcatttacattaggtatacctcctaatggtatccctcccccctcccccctaccccacgacaggccccggtgtgtgatgttccccttcctgcgtccaagtgttctcattgttcaattcccacctatgagtgagaacttgcggtgtttgtttttttgtccttgcgatagtttgctgagaatgatggtttccagcttcatccatgtccctacaaaggacatgaactcatccttttttatggctgcatagtatcccatcgtgcatatgtgtcacattttcttaatccggtctatcattgctggacacttgggttggttccaagtctttgctattgtgaatagtgccgcaataaacatacgtgtacatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttcttggctgcataaatgttttcttttgagaagtgtctgttcatatccttcggtcactttttgatggggttgcttgttttcttgtaaatttgtttgagttcattgtagattctggatattagccctttgtcagatgagtaggttgcaaaaattttctcccattctgtaggttgcctgttcactctgatgggggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaactagggaatcctttccccattgcttgtttttgtcaggtttgtcaaagatcagatggttgtagatatgtggcattatttctgagtgctctgttctgttccattggtctatatctctgttttggtaccagtaccatactgttttggttactgtagccttgtagtatagtttgaagtcaggtagcgtgatgtctccagctttgttcttttggcttaggattgacttggcaatgcgggctcttttttggttccatatgaactttaaagtagttttttccaattctgtgaagaaagtcattggtagctggatggggatggcattgaatctataaattaaccttgggcagtatggccattttcacattattgattcttcctatccatgagcatggaatgttcttccatttgtttgtatcctcttttatttcgttgagcattagtttgtagttctccttgaagaggtccttcacatcccttgtaagttggattactaggtattttattctctttgtagcaattgtgaatggaaattcactcatgatttggctctctgttggtctgttattggtgtataagaatgcttgtgatttttgcacattgattttgtatcctgagactttgctgaagttgcctatcagcttaaggagattttgggctgagatgatggggttttctagatatacaatcatatcatctgcaaacagggacaatttgacttcctcttttcctaattgaataccctttatttccttctcctccctgattgccctggccagaacttccaacactatgttgaataggagtggtgagagaggtcatccctgtcttgtgccagttttcaaagggaatgcttccagtttttgcccattcagtatgatattggctgtgggtttctcataaatagctcttattattttgagatacgtcccatcaataccgaatttattgagagtttttagcatgaaggttgttgaattttgtcaaaggccttttctgcatctattgagataatcatgtggtttttgtctttggttctgtttatatgctggattacatttattgatttgcgtatgttgaaccagccttgcatcccagggatgaagccaacttgatcgtggtggataagctttttgatgtgctgctggattcggtttgccagtattttattgaggagttttgcatcgatgctcatcagggatattggtctaaaatacacccacttttatatcatattgcaaagtagtcataatatttatcatgtgatatgttatcaccctcttctgaactcctgcgtctgttattacctttaactagttgctagataaattgtaatgccagctttacatcttttctgccattgtcttaaactgttatttaacttctttattatggtttaactttcttatatgtttatgttagctccccagtagagtggaagatactttagagataggaacatagtttatacatccctctattcctcctaattccttaagtagagtcacccaggaagtatttattgatctgatttaaccagttcatgtggcacaataagactttttgttttgtacattataccctgttaatatggtcgcaaatagtattgggttttggataattatttcttagtatgaactcataatgagcccagaacccactttttcctccaagtttctgtctgtccctttctcttctaattttttcaaaaatgtgcatgtcatccctgtgcagggaccatgctaatcttctctgtatcattctaattttagtatatgtgctgctgaaataagcgcctttcgattttttttttttaagatggagtcttactctgtcaccaggctggagtgcagtggcgtgatctaagctcgctgcaacctccgactccctggttcaagcgattcttctgcctctccagtagctgcatttatgggctcgcgccaccacgcccagctagtttttttttttttttttttttttgtattttaagtaaaaacggggtttcaccatgttggccaggatggtctcgatctcctgacctcatgatctgcccgccctggcctcccaaggtgctggcattacaggcatgagccaccgtgcccggccgccctttcaattttttttttggagacagagtcttgctctgtctcccaggctggagtgcagtggcacgatctccacttactgcaacctccgcctcctgggttcaagcaattctcctgcctcagcctcctgagtagctgggactacaggcacacgctgccacgcctggctaattttttgtattttagtagagacggggtttcactgtgttgcccaggctggtcttgaactcctgagctcaagcaatccgcccacctcggcctcccaaagtgctaggactacaggcatgagccactgtgctcagcctagttttttaaacaagaacccttctatgcctttacttaaatatcaatgtaattaaattttgatttattgttcctcttgttagttttagctttattatcacatatttttcataaatatctttgtccaagtaattaataaaacattgtttgctatatttgttttccgttgctgcataatgaattaccacaaacttaattgctcggaacaacaaccatttattatcttgcagtttccatgggtcaggagatggtcgtggctcaacttggtcctctgctcagggtctcacaggctgcaatcaaggtgttggcagagctggtggtctcatctcaggctcggggttctcttccaagctcatgtgattgttggcagaatttagttctttgtggttgtgggattgaggccctcagatcctaggggctgcctgcaattccctgtcacatggtctttccataggcagttcatataacagcaccttgctttttcaaggccagcgagggataaagtctcagtttgtctctcacaatggcaagaaggaatcaataatatacacatatatacctagtcatgggagtgggttctcattacccttgccatattctattggttagaacctactcacatgtcccactcatactcagggaaaggtgattaaacaaggacatgaataccaggaggtgggcgtcattgggggtcaccttatggtctgtctgctatatttggcatagctctgaatcaggctaattgaagactttctttttttctttttctttttttttatttttattttttgagatggagtttcgctcttgttacccaggctggagtgcaatggcgtgatctcggctcaccacaacctccgcttcctggattcaagcgattctcctgcctcagcctcccgagtagctgggattacagtcatgtgccaccatgtgattttgtatttttagtaaagatggggtttctctgtgttggtcaggctggtcttgaactcctgacctcaggtgatctgcccgtcttggcctcccaaaatgctgggattagaggcatgagccaccgcgcctggccaagactttttaacttactgttatccatcaacaaacactcacttgggtaaggctgctctaacagctgtgactctaactttactgtcatccaccaaatgttttttcatctacttacaaagataaaatgagagatgatgttcagtagtttgcctgaagtcattcattgtgtggggccttccactgagacagagtgctggagtgggagcaaagttgagatgatttgaatttgggtgcctatcagatatccacctagagatgttcatttccccatggcctggggtatagagagggtctgggctcgagtagagatttgggatccttcatgtatagatgatatatgaagcctaggatatgagtatactttgagagggaaaaggtgccaagggtagaattctgggggaaatccaggtactcagtttgagggatttccctcacctccttatatagcaacccaaacaaaaaggaaacaagttatccagcctcagaggaaaagctgtattattttgtctacttctgcttcagtcccttctctgtttattgtagatactacttattcaattatacctcttttcttctggtttcttcttctcttcctttccactggacccattcgctgtcgtccataaacatgttctggtcttcgtttgctgtatcttctagctaccagtacctatctagtcagccacttaatttttctgggcctcaatttcctcagagattgagggacgtgatgtagggaggaggttatgatttttaagaagcctctttctgacctaaattctgttctgccatcttatttctctaccttttcccgttttgggttgtgttgactgttcagttcctttttgaaacttccctcccttggccacagagttgtactcctctagttccctttctgcctgcctctgtcactgcttctccattacttttgtttcctcctgcctcctaattatgtccatattcaggggtgtaaagttctttaccttttttctctttatactcactgcctcagaaatttcatctacactcctggcttcaccttttttttttttttggtttttaattatagaagtaacacacaattacatgttcctattaaaaaataatatagatgcatctagagtaaaaagtgaaaatgccccttcaacctcatcctcagacgtaaccaccattatcggattggtgttctttctccaggtgttgagtcccagatctataaaggtagctctaaactctagatagctgcaatcaggatacccttacttggatgctccactatcagcatataaaatcagctagctgaatgactttgggcatatggttgatgtgttttttttttaattctgtggttctttcatgtcttatatttatttctttttgtgtctccatagcattaaacggtagatattccttacatgtttggttgattctgttattttgcagctgataacctctcattagtactccttcccaatttgcttatatgcatagacccaaggaaatagaataaccctctgtcagtactttagatgaaaaggtgggtggctgagtatagggcttaatcactgggaaccagaacacatgagcaattcagcaggtaacagtaagtatgggggcttaaggagaatggggtggtagatgggtagtatattgaaaactttggtcagtaaattaaagccagggtgctaacattaaatatatcatgggttgtaaaatataaatatcttaatctaaaatattagctaccaaaatcactgttcatgtgaaaacattgttttggctctgaaaaagatacatggataatctctgcagtgtaatgggtcattttgcaaaagtatattctactatatgtgtattaaatgcaaattaattggaaagattgccaatgagagtgtatcattgcatgttgtattaatgaggctgtgttgcataagcagttacacactgaaaattgccagtctctgtaaaagcttaattccaaagaaatttaggataatcatggacaggatccatagtagtggttctcaactaggggcaattttaccccctggggacatttagcaatgtctggagacatttttgtttgtcacaattgtggggaggtgttactggcatctagtgggaacaggccaggtaagctgataaacatcctacaatgcacaggccaactccctaccatgaagaattatctgacccaagatatcagtaatgctgaagttgaggaaccttgatgaagggaattttgggtagggcaggagatccatggcggtgaccattgatgcccctttgtattaatgctgatgtcctgtaattcttaaccttgctacctagttgaaagctagaggatatgacaattgtttggcttttaataacagcatacatatcagatagatggacaatttattttcttttctaggtgttctggttatttgactattaaagtaaattatccccagactttttcagtgctgattttttttcaaggggaacttaccgccagaacatttaaagagcgacagacaaaaatgttgagacttgataaattttatgttgagttattgcatattaatacttagtcctaaatactgtacgtgaatgtatcttaaactgtgatatagctcaggggtgtaaatgagttgccttaggtaatgtagtgatttattcatagacccaaggccagaaatcagattccttgattcccagaccattattccttcaatttggctatggcttctgtataacatcttttctgctttgagtctcctgaagagcagaatcaagtatgtcaaaaattgaatgatcttaggtgctggatgttttgcacatttatgcaagaatattcaatgttaccagtcatcttaaaaaagcaacaaaataacccaaaataatgctgagtaaaacacaagaagttatgttactttttcacttggtgacatggatgaaatattacagcaaatggggacagagcttaaaggaagtggtagggtgaaaggaccgttagtataacacagctggatggcatttctctaagctaccattttgaagaatgttgctctttggactgactcccaaactccatctggctagcactttggaattttaaatgggtaaaaaatatgattttccattgctcccagctgccctgcatggtttaatagacaactatgtaaaagacagggagtagaaccagcatttgatttgctttatgaaattgggaaatacacttggttttttaagctcaagttttttcataggtagatgatatggtggaggattatggtagttaatatttattgaatccttacaatttatcaggtactaagcccttccacatattattaaacctcaatatagttctataaggtaaataccatattaccccccttttaaagttgagaaactgaggcaaagagaaattaagtaactagctttcacagctaataagtagttcctggtatgaattgagatatactgtaagtgtaaaatacacaccagatttcaaagacagcatgataaaaaaatgtagaatatctcaacaatgttctgtattgattacatgttaaaatgataatattttgctttttttaattcttagtttttgtgggtacatagtgtatatatttatatacacttgaaatattttgatacatgaaatattttggtacatgaaatattttgatacaggcatgtaatgcatagtaatcacatcatggagaatggggtatctgtcccttcaagcatttatcctttgtgttacaaacaatccaattatactcttttagttctttaaaaatgtatagttaaattattattgacttatagtcaccctgttgtgctatcaaatagtaggccttattcattctagttatttttggtacctattaaccatccctacctttcccatagtcccccactacccttcccattctctggtaaccacccttttactatctatgtccattgaagtaatattttggatatattgggtcaaataaattagagcgttaaagttaatttgacccatttctttgtgcttttcttaaggtggcatccagaaaatttcaaattacatatgtggctcacatttttatatttctgttagacagcactgctctagaggtgggtgatatctcatccttatatcatgtacatgagactaaaggctgaggaagccaaaaaattaaatacattggattaaagtttgctgttgtagccattaagtctctaaggtgacattaggcctattctctaatgtttgcattattaaggggtaaggaacaaggaagcttttaaacttaggtacattctagagttttagtcccatacacatctgttgaataactgtgtaaggcattgtgttgatactgtggctcatataaaaatcagtgacttagactttgccatcaaggagcttataatgtggtaaaagaacatgtacacacacaactgtacataaaatcatatataatggagtggtagaaacaaagggcttagaatcttaagagtacaagaggttatttgcagctagcatgagggtggaaggtttaggaaggaggtgacatttgagctggttggagaaagatggataggatttcagtagaggtcccctctatactcaaaggaacatgcagaactaggtgacaggtcactgagctgacatgcttttctcttcaccaaacggaaactctgtgtggcacaaaatggagagaggtcagataccttgacatgtgggttttttaagggcccatttatgttgatatgccttcctcatcagacccctgtcttgcatatacatagaaatttccaatcatagaatacactgcttatctaagtcttttggtttctgacatcctggatcagccaggcagcaagtgatgaaacacacatatgcctgtgcatatgtttctagttatgcatagatgaatgggcaggcagataaattgtttttaaactgtagttaaaatggccccatcttgaaatttagatttaacttgaatttctcttgtctaatctcttgggcaaataattgtagctcctaccatggggaagaataaagaaaggggcagaaagaggctgggaatgttactctaacagaagtatctctaccttgaagtgggaacagtgggggaaaaaaatactctcctcactccaccagtaccactatgttcaagtctggcctttcctttcagctaccaattacttgtcaaatggattggtttggttttgtatggaggtcatttggctttaccaaaaaaaaaagggaaataaaagactattattttcaagataaaacctggaaagaaaagaacctatacccttaagtaggaaggactctccagtctatatttgcagacgggctgactttgtcttccaggtgggtttttttttttccagttgtttgttttatgctaatagagttttgccccattaacatagaatatgattcagtgactccttcctgctctccagaggacacctgtacagttaattggcttttccttttatagaattctaaaatgttaaagctacaaatggatactcttatagaatgttacagtagccaaatcccttagttaaaaatggtaatgtagctcttctctttaaaaaattaaaaataaatgtaatatgttattgtaatatgtatttaaccagttttaaaaattagaaaacataaataagaaacaacaaattttaacatcccagatttaaaaagagagagaaccattgttaacacccatgcatatagacttctagacgtgtgtgtgtaactttttttttttttttttgagacggagtttcactctcgcccaggctggagtgcaatggcacaatctcggctcaccgcaacctccgcctcctgggttcaagcgattctcctgcctcagcctcccgagtagctgggattacaggcatgcaccaccacgcccagctaattttgtatttgtagtagagacagggtttctccatgttggtcaggctggtcttgaactcccagatcacagatgatcagcctgcctcggcctcccaaagtactgggattacaggcgtgagccactgtgcccggccgtgtgtgtgtaactttaataaaaaatggatcacatcattttgtaaagtatctttttcatctttacattgtagatatgtttctatattgacacctcttcatctacaataacttttttgtgtttttgttttgttttgtttgagacgaggtctcactctgtcgcccaagctggagtatagtggtgcgatcacagctcattgcaatcttgaccacctgggctcaggccatcctcttacctcagactcccaaatagctgagaccataggtgcaggccaccatggccagctaattttttaattatttgtagatatggtttctcactatgttgcccaggctggtcttgaactcctgaacttaagccgtcttcctgcctcggcctctcaaagcattggggttataagtgtgagccaccgtgcccagcctacaataacacttgactactccattttattgatgtaccacgagttatttaattaatccactgttattggatatttaagttgtttccagtgttccctatcattacatgtgctacagtgaatgtcctcatacttaaatctttctgtatatacttaatgtttgtttagtataaattctaaaaagtagaattggataggtaggagggtgaagattgatcaatgtatactatccccagtagtcaactgaactcttgccaatcctgtgtattctcgttcagaaaatgcttgtcaatttggtaagtcaaaaagggctttttgttgtagtgtattcctttagttacgacgatgttggactttcttcatatgcttatattattgacagttctttattgggcacttttaaatttatttataagttatttttaaggatagtgactctcataatgttgcacaggttgcttctcagttttgatatttgctttgtaataaatttatttttaatgtccatgagttttccacttttatacagtcaaatgtatcagccttttcctctatggtttgtactttacacatatctcaccacagagcaaggaattctaagggccaaggagatgtgcctacctgcctgtttcttctagaccaagcttgtgcaacccgcggcctgtgggtcacgtgcagtccagtacagctttgaatgtggcccaacacaaattcataaactttcttgaaacattatgagattttaagatttttttttttttggtcgtcagctatcgctaatgtattttatgtctggcccaagataattcttcttccagtgtggcccagggaagccaaaagattggacacccctgttctagaccatactctaggtacttggaagctgaggaatctctattcaatgtgcttccagggcttgcgagggcctctgccctggatctgtcctctcaaggagagactgtgccatatgtgtgagctcttctaggtctaaggggtctaagggggtgcttgtttggtgggagaagtgtatggatggagcttggctgtgtggactgagtggtctacacacaggcggccaaggctcctagctgtgtaggaaggagtggggtagtggagagaaggaaggagaattaagagcctatacttacattcttgcccctggccttgtaaatattagggatggacctatttctcatagtaatagttataattttagttacagttaaagattgaatctttgtggcatttcctttgggataagatgagatcaaaaaactaacttttcccccaaatgccacccctttcttttgtagatggggaaactgagccttaggctgtaattggtccagagtcactgggctggttagtggcagagctgtttcttatgactgatagagtagtgctgatttttttttagacagatagacctgggtttaactctgggatctgttactaactcgcctttcatgtgttgtgcaggacaggtcacttaacctctcagagtctctaattaagtaaataagagaatcctacccaccacctatccctgtgccaccaccattccacccaactagctgcattttctaggttatgccccttgtaggcagtgtcgacctcagcctcttgcctcgttttgtggactgactgttgcctctgtttctaaaacagtcaaagctctatggcccttagttgaaacctgtaccctttaagctccaaccagaaccctgaggatgggaatacacatatctgtagacacccaacaaagtatttgtgttttacagagttggcatgtttttttttttttaacagcttccgattagctgtttagtcaccccccagcccatgagtcccccatgaggtaccataagcatagccactgtaaaagtctctgataatttgactgcttttgaatactccttgtttattataatgactttcgtgtgctttccactgttcaatttatttttcagacattcatctagatttgactcagtatctttacattctgtctttacttttaatgatgtacttactgtgtactccaaagacagttcaacctagcaactattaaactgactttcaacatggcacgattctttctttttttaatatttaatgaaggaaagccctactgctctatttccccagaggtagaaatctcaatttatgttgtttgagctgggagaacttgttaattaaaactgtcgaactgtagtgaattttgctattttaatatatgtttcatcagttgatgggggcaggggttggaatagtaaagagtacacagatacttttgtgatttggttatgatgagactgatcttctaatggatcttcaaattgacaaattctgggaaagccaaaaaccaatcccaatctgtatagaactgtaccactattccaaaggtctgtcttaattctttgagcctgattctcttgccttcactctgctttaggaccagtctgctttaggacattagagctaatattagccttagactggagccatgccacttccagaagggttccacactgggttttgaatccaaacaggcctaatcttccaagattcttaaaatcctattgtcttacctttgatctagtgcagcctctgactaaggctggcatgccactcaccctgcagtggccttagcaggtgattgttccagctaccccacaagcagtgactctggagtgggtctgcctggatttgaattctagctctgacacttgactagctgtggttatagccacattttactcctctgtgcttagttttatcatctgtaagatggggatagtagtatctgcctcacaggagtgttgggatcattaaatcagctaataaatgtatagtactaatgtctactagcctattgttgttgcttttgctgttgttattccgttgtcatggagattgaaatgcttgaaaatccttccttatattcagctgaaacctgtctctgttatctctaaccactgtggctgcacagaggaaagtataaccctttccccacttgctagcctttcagatacgggacaggtaaggacacatgtatgaaagcacattgtaagctgtaaagtgatgtgttacctacaacaaggtatttaatattatcattatattttaacctacattataattattatctaacttgtcctttctatctgccacatcttatcttttaaaaactgcatactttgcgttccttctagcgttctttatatgacatgatttccagatatttaaccatcttagttgccttatttgggatatactcaggttcattcatgtctccattaaaatttggccctcaggaattgacttggtcctgtataggcaattgagctagtacagagcacaacaataatataatatttacctctcccctctcttaaaaaatacataccttgtggccgggcgtggtggctcatgcctgtaatcccagcactttgggaggccgaggcgggtggatcacttgaggtcaggagttcaagactagcctggctaacatggggaaaccccatctctactaaaaatacaaaaaattagctgggcgtggtggcatgctcctgtaatcccagctactcgggaggctgaggtatgagaattgcttgaaccccggaggtggaggctgcagtgagccaagattgcaccactgcactccagcctgggcgacagagtgagactctgtctctataaaagaaaaaaaaatacataccttgttaatgaagtggaatattctgccagtttgagggaatattatcattctgttgactgaagagctttttagatgaagtcccattaaactgttttaaccattttaaaacttgcatccacttattttttcactagataatttttgagtcttctttgtgccaggcactatgttgcattctggggatacaatggtgagttctacctttatctccattacctttcagttcctagcctcgcctgttggtatttttggattctagctctatttgaaacacattggctgtgtctccatgttttatatcattcatgaattttatgatcatgtttccgctgtcttttctaacttggtggtatttcagtagtgccaagtacagagccctgaagcattcaagttgatcttctgtgaggctgacattgatccattaattggtattctttaaaaactctttttattttaaaaacaattattgattcagataattatggttactgcaaacaaatgtacagggaagtctcatgtacccttcctccagattcctccagtgatagcatgttacaaactatagtacaatattgaaaccaagaaactgacattgatacaatccgcagggcttattgatagagaggtggagagggagagagaaagggaatggggggagggagggagagagaaagaaatgagagaggctccatgcaactttatcacatgcagctttgtgtaaccatccccactatgatcaagagactttactatcactacaagacttccttttgctgtccctttatatagccacatcccttcctcctcctcatttctaatccctggcaaacactaatctgttctccatctctataattatattattttacaaatgtcacataaatggaattgtgcagtatatatccttttgagattagttttttttttcactcagcataatttatttgagattcatcccagttgttgcatttagcaatagtttgttccagtggcattcttgttgagtaaggttatttgatcaatcataaatcatcctacttgttcaggacatacctgtctcatatgaacatattctatagggaaaaaatgtcttcagtgacttactgaaactcaaaaacacttcgttccattacctcagtctatgattctcatgacctgatcattgttcataaccatctgtttactagttcattataaactgatttttttcccatcaagattagcagtctttgttttcagagccatttcagaaataccccagctttttagttttacaagtaacagccaaatttttctagtctgctatgatttttttcagagattaccagcagtggcctctcaatcaggacagtaggttatctcaatactataagatatactttatctgggcctacaggtccaagttcatttgaaactgcttgctactctcactatctctacatcagttgggctgtgatgaactcttattcacatttgtgctactgtttccagtttgaaaaattattcttatcatttaagatgaaatagaaatagcaactgagtcattctacttgcttgctcgctcgctctgtctctgtcacctgttcacatatatcttctacttagggtagatgatcttactttgaaaaatctgcacctgctatagctacattagttcctgtagcctaaaagcttgttttctgtgcagcttatgttgtgttctttagtcacttctcctttttttttcttcaagatcatgggggattgataatattttgagacctatcctcccaaatattttattcctcttacacattagtccacttaaggttcactgtggtctcttgtagaaattctcattctcagtatctggggaataccttcattccctgttgtttttgtttgtttgtttgtggttattacccaacaatacttaaaatgacatggccatatttcctaaagtttctttcacttctacttttaccaatcagttcttctttcttggtcaaacttagttacaaagtttgtagttcctctcattgctttctcggcatcctaaagtatggaattttccttttataagtgcaacgcacaccttcccctttcataagcatgttatttcctggctgacattcccttctcagttctcctgtgccctcccagaactcttgttccttgatcaagcatgtccatatattcgcagccattttttttccagaactctttcccttgatgacactgttttctccacagtcatcttaaatggagcctgctcatttgccgataattcctcaatcttaagctagcttctggtgccagaatgttgttcaacaactttccttttcccttattctttgacgtgcatgctatcagttattatgtctattcctttcattggcacagacctatctttaggttacttgctctcattctatgagacctctggaacctagcttagtcttctgtgctcctctgactccttgcatcatcccagaccatgccagtagcctccctgatgcatcatcagatgtcacagcatgatatttccttgccctacgataatatgacctccattttcactctgcttcagcaacctcttcatatggggggcacacttattaatcatgtcaccatctggaactgttctacttctgatacttaaactctgaaattcagctttttgactaaaacctccagcctttcacatctcctgttccctgactttcacagaacctctttgacatcatcatcacttccagttccttcccctttctcccaggaagttttctagccttctcctgcttctatgttctttcccacccagcaagcatttctaacccccacttgaccctgccaaccatttgatattaattcccacagtatcctcaattccctcatgtccctcttgttccactgcacctgccctgccaatctccagacctagatggacttcagcatctgtttttttctgttctgttcccaggctgctgagtaagtactagggaaaattgtctcaccatgctgattatatccatgaccaaactgtgatttctaaccacagctggatcctcaacggctgttcactaatccttttttacacattcctggttggtttattttccaaattcccacagcaactgttccattttcttaccacacccctcaggcctcctaacttagtcctctctatccccagcttcccctcagcaggtaatctattatatagattacctgctgaggggagctggagaaaagagagagcccattggtcacaaactttctctttcccatccaaacatttatttccatgggtactttcatcttcattcttttaatatcatcttttccaaggctaacctcattttcctttttacctatcccctgatgcatcttttaagatattctgttccattaatcatctcccttctctctcttgtatcttcagtgtttttcttaaagagctttttattctgcctgcagacatatccaagaatccccctttcatttcctaccccaaaatcttctttttaatcatactatccccataggctaatgggatatctttttctcatactttatttcaaagtatgttaaaagagccatctatacttccttatctttcagtcttcagctcttgaaatctggcttctgtacccttccctctactaaaaactgacctctcacaggtcagcatgacttccagattcagattaggtgggattatgtgtcccaagacacgcaaaacagaggagggaagacgtgtgtgtccacgcacaccaggttgcccatgcctgtttagatgagaaaagaagtatgaagcaggaggaacagagttcgatgctacatctttcttctattccagggtggttcatagtgtgatccagtaacacattacttctttctctgcttttattattgacaaatgtttttaccttctggtttgttaaattccataaggaagtgctacctttttattacagatgagatgatgatgatgatgatagtggccacctactgtgtgacatacactgtgatagatatttaaatacattctaaactttaatcttcattaacagcttagtgaagtaagtattttaatacccaattgatccatgggccacttaaggttcagagagggcaaatgtcttgaccaagatcacatgacaagtaagaggcaacacagagggttgaaccctggtcagcctggctggaaagcaccttccttaactattacactattgccttctataatcgagtgccagatgccatctcaccagctcttgatgatcataactgtgagattatttttgctttttgctgtttcaagcatcctaataactttgttaccagtcgtactaaatcggtatgtagactcctctagccctaggtatgatttctggcttttttgccttgttttctcttgagaagcagtgaatatcccttccaatatggtttttctttgtcacagttggtggtattttttccttctcttgacatttccctttcagtccatatttatcatgttagtgaatctccagcgaaatcatttcttcctgctctttgtgaaattttctccatccctggccagaagtccatcattctgagattttaagtgattctccagaaaaactacatcctattatttgacatcatctaagtagcaagatattcatttctcatatcttctctcctagtgaaaagtcatgaccttcaacaggaagaagcagtgaaaagcttccatgtgccctttaagtcttcagttttctacctaagctttcaaagtcagtagagatacagtacaggtccctcttggttatataatttgttcccagatctaaacatttgcatgaataaaaataaactaaaagatgcataacatccatgtctattttattgaaagagtcaaaaaggtacatgacataaggatccaagtgggactgataaataaaaaggcagcttctgctgttaatggggctgagacaattgcaaggttaacaggaaacaccgcttctcccaacgtcacacagcagctggaaaatgccatgaagacaccctctttcaatggctactgctttcttatcaatgatgcttcaagacccacttggctcttcccatgtattactggagattcccaattgctgagctgcaattgcccatagcagcggcgaatccctaatttattcctgcttctcctgttcctgcctcataaatcataaccagtccagaactgatccctgcatttcttaggccttcctcagaatccttcaccaggaacccacaagaagctttttcccccttcttgttgagcacattccatgaatcctctggagtgttgtccttatgaaagagtgaacagatcggactttatcagactacaggcttgtccttggtggtctttagttgattaggctttaaatgtcattctcaccttgagcttccctcaaatgaaaatttgaactatttaatttcaagcctggcccggtcccatcttttctgccatgaaaatgaaagcccccacactcttcttggctcagtccaggtatagtgctaataacagactgatctggtgccatcttaagcctaggggccgtagcatgagctaacaatccagtattagaatgataatagggaattgacatacctgggtcagtcctatacatggtggtaaaaggggtacagacttaatgagcagccagtgactccagaaggagctgagaggtgaaagaagtgagagacataaattggcttgaaacatatttttaaggaagtgcttgaattgaggtaggtaagaacaagtgactctgggcagattaggatgacttgtgtaaaaggatgggtgcgagaatgaacaagtcatgttaaaacaagagcccttcctttgagactggagaggcgaagaggaagaaattttacatttgttctctcttttttgggaagtatgtggtttaagggccagggagaagctgattaggatttcagaagatactattaaaacaggtggccatcatagtaatggaaaactagtctagtctagaaaagaggaggaacagatatatctagcagtatccaggacagggtggtaaccatatataacttatagcatgctctatgctgaaaaaccccaatccatatgtgtgtacatatgtgtacataaaccaggcagcttcttttgaaggtactttacttgttatctggagagaagatgtttttaacttctgctcaccttgaccactcagagcaagaagatatttcctccttcttaattctggccttacatttggaaaaagggaatttgatttccatccttagaaggccatctcaggacaaatattacaaatcagccttccctgcaaaagagggacaaccagtgaattccgtgtcagagttattctgaagacctgtgctgttttctagtgaggccatttaggatatagtaagtatatgttcttcctgtttgtggaccaggtttaagtctgtctttttttcttgttatcactaagaagagctaaggaatgcctgcatcatcattttgacagaaaccaaaactttaattctgctgtttttgaagtaaactagcacctttcttatcttgggcaaattcattgaagcttgttaaccagttaggtggtaactctacctctttattccctatttggatgtaatgcatgttgcatttttaactctgactatataaataacaatattaagtatggtacagttgctttggcctggaaggatgtttgtccagcaaccatttattgagcaccaacaatgtgccagaaaatgtcaaacgatgtcgagaaaaattgagctgcttttgttcaaatcaaagcagtaaactacttctaagatatgttcttcagaaatagttgtcacaggagcagtaggtaagagattactttttgtaaagaaacttcatgaattctatccaattgtaagtaaagtcactgcatgttagtgaaaagtgtagcttgaaatagatttttgtcagttacagctgtaatgaacaagtagcaatttaattatttatattttacttaaataggatgaactgtgtgccaggctttattctacgcaccttacaaatattaactcataaatcctcacaaccaccttatgaggtggatactgttttcaccccattgtatagatgaagaaactgagtcacacagagatttagtgtcttgcccaggattatgtggctattaagttgtgatgttaggatttgaatggactctatttccacaatctgtgggatctatactaagctgcaaataggttcttactgagtggcccataaagttaattaagtggatttatcatgccctctgaagtcttgtttatgctattaatctgtttatcaaactcatttatccctatataaagatctttttctacccagctataatcaagattatgacaaattctgaattctatttattttttttatatattattttaagctaattttttagagcacttactatgtaccaggcacttgtctccaaggctcattctttcggccatcacactgttcagttccacaagccctctcttttccattgctccctcaacagcagaatcctacagaccgcacataggatacctttattctgcctcaatttgttagtgaccaagtctccaaagttcaggggaaaacctttcttgaactatatcagtatgtacaatgactgaaaattgtgtcatgtacaacaaaatatatgtactctctagggcacccagcaggattgaaataagtcagtcaacagttttgtatagctcattccatttggaaggtgaacagatggtgtcacttcagcttactcctcctcagcttaaaatcaggagcatcagagtaacaaaggggctgaaggtgggtctgatgatttgtgagattctgttccaccttgagaacatgtgatttttatcaattttttcagctctattgagatataattatatacaatataccaagatatctttatgtaggttgtattccatttatctcagcaatattttgtagttttcagtgtacatacaggtcttgcatatcttctctgagatttatccctaagtatttcatggttttgatgctatttaaaatggtattttttatttcaatttttgattgttgctagtatatagaaatagaattcattttttacattaaccttatattttgcaatgtgctaaactcacttatcaattttagtaatggtttttgcaggtttaatacatagatgagcatgtctcctgttaatacgagatttaggtgctcctttccaatctggatgcttttatttctttgtcttgcctaatcccactggctagaacctccgatataatgttgaaaagaagttgtgagaaccttgccttgttcctgattttagagggaaagcatccagtctttcatcttcaagaatgatatttgctgaaggttttttttgtagttgccctttatccgctggaggaagttcccttcaattcctagtttactgagaggtattttaaaattagaaacaaatgttagattttctcaaatggtttttctctatctattgtggtgatcatatggtttaatagtcttttaatatggctaattacattggttttcaaatgttaaatcaaccttgccttcctgagatgaaccccactgggtcttgattatcggctttatatattgttggatttgctaaaattctgttaaaaatgtttacatgtatgtttattagtgatattggacttcagtttttttttctcaagacatctttgcctggttttggtatcagaataatattggtctcatagaatgggtggagaacaactctgtcactagaactagtattatttcttccttcaatgtttggtagaattctagtgaagccatctggacttggagttttatttaggggaatgtttttaactacaaattcaattttttaatagatgtagtatattcaagatatctacttcttcagtatactttggtaatttgtgtgtttcacataatttgtccatttcatctatgttttaaaatttgtgataaaattcttcatggtattttcttacatgtttaaaatttgtagaatctgtagagatgtcccctctcattcctgatagtgataacttgtgttgtctctcttttcagtctgttctgtctggttaggggttgataaattttatggatcttctcaaagaactagctaagcatttccttgatttttctttcatttttatgtttcctttttaaatgttttctatctcattgatttttatatctctgatctttttttttttttttttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagaccacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatatctctgatctttaatattttatttttttttcttactttgggtttattttgcttttcatctcttaaatttcttcaggtgcaagctgaggcattgatttgaaacctttctttctttctttctttttttttttgagacaaagtcttgctctgttgcccaggttggagtgcagtggcatgatctcagctcactgcaacctccgcctcccaggttcaagcaattctcgtgcttcagcctcccaagtagctgggattacaggtgcatgccaccacatccaactaatttttgtacttttagtagagacagggttttgccatgttggccaggctggtctcgaactcctgaccgcaggtgatctgcctgcctcagcctcccaaagtgctaggattacaggcatgagcccctgcacttggcctgagacctttcttcttttcaataatggtgtaaatttcccttcaagtcctgcttaagtagcatccctatttttgatatggtatgttttcattttctttcaatgcaaaatagtttctaattttccttttgattacttctttgattcatgggttattaagaagcatgttaatggcttccaaatatttagtggcttttgcagctatctttctgttactggtttatttaatttcattgagtttcacctgagaacagactatgtatagtttgggttcttttaaattcgttcagacttgttttatggcccagaatatggtatatcttagtaaactgttctgtgtgcacttgaaagtaacgtggcttctgctgttgttgggtggtgtgttctaaaaatgtcagtagggtcaaattgtttgccagtattttttaaagtcttctatatcctgattttcttctatcaattattgagagagtggtgttgaaatctgtctgtgattatggatttatctatttctgcttgtagttctgtttttgcttcacatatttgaagcttggttgttaggtgcatgcatgtttaggattactatgtacttttgatgaattgctccttctaatatcatgaaatgaccttttttattcatggtaacagtctttggtctaaaatcttctttctctgatgttataaagacatttcagctttcttttgattggtgttagtgtgctatatcctttcctagctttttacttttaacctatttatatcattatatttaaatcaggtgttttgtaggcaacatgtagttagtaggttcttgttttctaaatctagtctacaaatttctgctattaattggttttttacaccatttatacttcaaagcagctttatttagatataatttgcataccatacaattcacccatttaaagtgtacaatttaatggtttttattatatttagagttgggcaaccatcaccacaatctaatttaaaaacatttctatcacctcgaaacactatgcccattagtagtcaatccctactccccctacccgcacctgagcactctaccaccactaatctacttcttatctctgtggatttgcctgttctggaaatttcttataaatgaaatcatacagtatgtggtctccgcataatttttttcaaagttcatctatgttgtagcaggtagcaaacagtacttcattacttcatttgttttatagctgaataatattcctctgtgtggatatatgctacatttaagaaaatccattcatcagttgatggatatctgggttgcttccactttttggctattacaaataatgctactatgaacattcacacatatgtttttgggtggacatatattttcatttctcttggctatatacctaggactggaatttctgggtcatatgataactctgtgtttagtattttgagaaactgccaaactgctttctaaagcagctgcagcattttacatttccaccagcaatgcgtgaaggttccagtttctctgtgtccttgccaacacttgttattgtctgtcatgagatatctttccattgatttaggtctttaatttcttttaacagtgttctggagtttttgcagtacatattttgtacttctgttaaatttattgctaagtatgatactattttggtggtattatttataaacgcaattgttttcttaacataattttagattattcattcctagtatataaaaatgcatggattttttggtatactgaccttgtatcctccaaccttgctgaacttatttattagttctggtagttttttggtgaatgccttaggaatatatatatatataaatatatatttatttacatatatatttatatatatttttatatatattatttatatatatttatatatatatataatcatgttatatatatttagaaatagtttcacttactttccaatctggatgccttttctttctttttcctgtccaattaccgtggctggaacaatattgaatagaaggtgtgagattgtacactttgtcttgttcctgattttaggtggaaagcattcaatttttcaccattaattattatgttagctctgggtttttcagagacggtctttaatcagtttgaagaagttctcttctattcctactttactgagtgattttatcatgaaaggatattgcagcctctgccctgggagtgaactgggatgagggtgatcaggacccagtgtccttggcctgctgcacctggagtggagacttagcgggaggagctcccattttcttggctacccatggaggagcctctgtaacccagagctggggaaagtggtaaggaagtagttcaatgctcagataccacctgctctactgttcgtgctaagatttagcagattttgttgaatgtatgtttgctgtatgcccttaggataatttccagaaactttaaatgattgctttaacaagtattttttgccagttaaattgttgctttacgagggagagaatctgccaggttccttactcttccattctggaactctcagtcaattattaggactaatttttaagaatgtatttggaaataatttcaaacttataaaaaatttgcccaaaaaagtacaaagaacactcttacaccctttactcagatttcagatttacctgtttttagcattttaccctatttgctttatcatatgcattctctggtgtgtgtgtgtgtgtgtgtgtgtgtgtgtgtgtgtgtgtgtgtgtacatatttctgagacacttggggataaaggtacatacctcatggccctttacccccaaataattgagtatgtatttattgggaatagagacattctcttacacaactatagtacagttatcaatttcagtaaatttaacattgattatcttctctaccatagaaattctaatcttcaaattatttttatccttcctccctctgtttttgtgtaagttttatattgtacgtaatattagtacaatggtacatacatgggagtaaatgttgaaatgtttttctactgacagacatgtgcgataaaaagttatgaagcaaccggtccagaggttgacaaaatgctttcgctgtatcagctcagctgatcctgccatcacctcatgacacaggcaagagttattttccctactcatatcacatatgaagaaacactaaggaatttactaaagatataaagctttgattaacaagtgttggatatgggcctcaaccccaggatttttgaccccagagtctgtactctttccataccaaattaccttgctgagtaagctctcagctgtctacatgtgacttttctactttatgagttttaaggcaatttaagatcatataattctaaaaattgtgccagatgcttccaacatacagaattgaagacatcgtggttcagtgaggttaagtgatcatcatttttaaaccctcccttaagcaaagtaggaaaaaggaaaccttactgtcatttctcttccttcactcaaaatcataacccccatacatcctcagaaatgtttgacttgtctgcttagcaacctttatatggtgctttactgattacagtgcattgtaattcattctttcattttagagccacaataacctggtgaaaacaagaccccaaggtaatgaatatgcactaaagttggcgaagcactcctctagagcacctcctcttcacttctgcacaaacctggctctgattgtcccctcacccatctctctggcaatgctcatgaattcttgtcatggctagtgtcagagagactttataccagatgatttttctgtggttgaaatcagcagtcttcagggtggaatatacaagataatggaatataggaagaaaataattagtattttttgccatttctctgttttttattctctgtatctttcttttttttagttttaatgtattttttaaaaattttattattattgtactttaagttttagggtacatgtgcacaacgtgcaggtttgttacatatgtatacatgtgccatgttggtgtgctgcacccattaactcgtcatttagcatatctcctaatgctatccctccccactccccccaccccacaacagtccctggtatctttctttcttaacagctttattgagatataattcacgtattatacaacccacccatttaaagtgtacaattcaatgatcttaagtatacagatggtccctgacctatgatggctcaacttacttttttttttttgactttatgatggtgtgaaagcagtagcaatcagtagaaacagtactcttcttgcagtgctggctggtggcagccaggtgcagctcctagtcagccatgcatttttaacttacgatattgtcagcttactatgggtttgttgggaatgtaaccccatcataagttgaggagcatctgattcacactaatttcagaacatttgtatcttaccaaaaataaactcccttcccatcagtagtcaccccccagccttgccaaccatcagtttactttctctttctatagatttgactattttggatatttcatacaaatggaatcataaaccatgtgttcttttgtgtctcacttctttcactgagcatagcatcttcatggttcatctatgtcatagcatgtatcggtacttcattcctttttattgcctaataatattccattgtatggatagacagcattttgtttatccattcaccagttgatggacatttgtgtttccactcttttgctattatttgatatgaacatttgtgtacgagtcttttggtggacatatgctttcatttctcttgggtagaactatgttcctagattagtataaatgccatgtgttaaattttgagagaaaaacaatagaaaagtaagtgtggctcttggaggggatggaatttttcaccttccatgttattcctctcactctgctccattttattgaccttcctatttagctctttactggcctttttttttttgcctattttcctgtccacttcttactcctgccagggatgctctggggaaaggaaacatttattgactaatattgaagtgcacatttagctctgtaacaaccttatgaggttggtgctatgaaacccatttaaagatgaggaaaataaggctctgagagtgtaactaacttattcaaagtcacccagcccttaagaggcagaagtgagataagcccatctctatctgattccaaagctctttccataggctgtctcccagatgaagtgcttattgaagttcagaggacataccttgcttctcacttgagacatcaaagatggaggtgtgaagggagaaaacgaagtgaaagatgatgccaagattttgatgagcctgtaggagtgggttgtgcaagaggtggaaggatggtaggtaccataactgagatactgaatacaaagttagaacctggtttggggaaggaaggagttggtgagtgttcagttttggacaaatggaatttgaggacataattcattcagctgatatttcattggcttctttatacaaggcacagtacaggatgctggagatacactgaagaacaagatagccatggtcactaccctaatggaacctgtggtcttagtaaggcagagagacaaaacaatggtaatcaagtgtaatgggtgccatgataggagaggaggaggatttaacccattaccagagtttgcaatttttttaaatttttgcatgggtgaaaaatcagaccttggcaatgaccttgagtagtaggatataaataactcctacatccttagcgttccaataatggaacactaggcataaatgggttaattgaagcatctagtgaaagtgattctttaagggtctgaggctagtagaaagaaaatcaaagtagccatagcttacagtacaggtgggacatagaattaccagagatggatataggagataaaaagatttaaaagtcattcataggaaagtaaagagttgataatatttttttcctccatttaccctcttcctataagggaggaaaataggattgcctgcagccacatggaacagctggcagttttctgactctcatcctcttatcatctttgcatatgccctgccctcttcctggagttctgatctcccatcccttttgtctagccaactccttcctatctttattatcatttttcagaaagcttaccatgaccccctgttccatgtccccatagtctcttgggcctacttgatcacacggtctcatctattaattgtgagtattctaagagttgggacgtgttcatcaatccaagtatccccacagtgcctgacacatagtgagatggatgtatgagtgattaaacaaaaaggaccaaataatgagaaagacctgcatcctttgaacaagtggaagaggcttcatcgcttcatggaaagagagcttggtcattagtctaacttggtggttcttaaccagtggtgattttgcttttccaaagaacccttgataatgtctggagatgttgttcattgtcaaaattggctagggtatctactggcatctagtgggtggaggcccaaggatgacactaaccatcctacagtgcacaggacagccccccacaacaaagttagtagtgtcgaggtcctagaaatcctggcctaatcttgcttagctctctcttacctaaagcagttattctcaaagtgtggcccccagccgtggcagcattacctgggaattgttaggaaaattctagggtcctacccccaaatccctgaaggagaaactctgggaatggggcccaacactttattttaacaaaccctccaggggattatgatgcaggttaaagtttgagaactgctcctaaagtgaaaaatctggttggtaacaaggccagcaccagaactctgagaggagccagcacagaaatggttgagggataatgtcagaaaaaatccacaggaggtgatggtttccagggtgaagggatcattggtatcaaatactgctagatatgagaacaggcaaagatgggggagactgccactaatagttaagactcctgaaatggaaggaggtaaggatgatgttgttacaaagtgatgggtttgtgcaaggagggggtgctgaaagcttttaatttgtactcatctatgcaaaagaactgcttttaaaatttctatttaatgtcaggcatgtgggaatagcatgccaggactatcatccctctaaaacagcagctctcattatttttgtgttttcttccaggctttgtctatgtacataactatttttacagtggagtgttctgctgtcacaataaataccaaggcgttttcaaaggttacgacagcaggagacagcattttgacatggcagcaaagataaacttgatcccattgtaagtttgttctgcttgaggggagggttgtttggtggaatttctaggaaaagcaaggcagatgcacttaggctaattttggttacttgagaagaaagcaataaaaacccctccggtacagaaatgtttcttaagcctcattaaggaagcaaggacacagataagacaatgtggaagaaaaggtctcttttagcggaataagcttgcatcataaatagtagatatccaaagtggtatctcagagccaccctgtggttcccagattttatttggattgttcctttgggttggattatttgctaaagaagctgtttattgagtggagttgaagagcagggagggattttagagtgtatctattttgagggagggggaattgaaacaggcgctgaggttagggatttgtttcccttataaaatgaatatattagggcagtgctccctaacattgaatataccctttaaaaaagttattgtgcataggggactttttctcagtcttttcaaaatttgtgaatatatatgtgtcaagcacagtgcacacttcacagcccagggaaatcgatggtgtatatgcaatttataaatgaggaaattgaggctcaaagaagtgaaacaatgtggccaaagtctgacatcaaataagtgtctggaggggaattctaaaccctggtatgtttccctccaaatctagtgtaatttccacagtgacacagttgccatatgttgtcacattcttagaggtatctgagactccttcatttctcttatcagactaatatgtagtcattacccaaggttgtatatgaggaccataaggggactttttcgaaatatctgtgttcagactcctcccatagaggacctctggagtgagaaaaagaataaaagagcactcaccctctcatctcctagtgtcttttctttcccccctccagaagcccaggctgtacacaggccgattttagagttgtagagcaggtggtgggcagggctgggctagccagcagcagcaagccgattcagctgtgatggtgacagctgctcctacccagctgcccataactagctgatctcaatcacctgggagagagacagggcgcaaaagggtcttttgtggccacaggcaaactggagtcaagctgcctgcgttcagattttatctctgttgcaaaccaacggtatgaccttgggtaagcggatcccttaaattccccaggaggcagaataaagtagtgagtacaggtaaggacgctgagatctgagggaagtaggtttaagctccagctctaccacatttactaatgatatacccagggtggacttcatgggcatgcaacctgtgcagtctcacagggctgggcacttggaagggcctgtgtgtgcagggtttaatcctctgctctcgctgtcttgaaattcttaatagtttttgagtaagggaccttacagtttcattttgcactgggccccacagattatgtagcttgtcccatactgcctttgggaaattacttaactgctctgagtcagtttcctcaaccattgaatggcgattgtcctgagacttatatgagaggatgcatgtaaagcacttgcttggcacagagcatgggctcagtagccagcattaacacagccctgggcatcagtgtcttcatctataaaaataaaagtgttatattagagcatgtctaagatttcttctacaaatacaatgtacttacaagatttccttgaccctaaccaataggaaaacactttggaaaacataatgtaaggcttcatttcctttcttatacagttttgatttttttaaaaaacatgtccatgttaattgtctctcttgtagctgctgcctgctagtcttaaaatctctttttgaaaattcttacagaatgattttaacctctaacctattttaagtgtgccttttatttagtgaatgtaatgttgagagagggtaggtttggcctgtaaactctcccaagagggtggactttttaaaaaccaatgtggaagataaagttaggaacaaagtatgtgtggaagggtgggggattgccggaggggatagcatgattaaaggggtgttgtggtcttgttttaaatacatcactggagatgtagaggtctggtggggacagttgaagcacaacctccacaaaggtgaggaagaagataatcaaaacacaggatgggggccaactttggagaggataaagggaatgtcatcctctgaaataagcaaaaatagcttgaagataccatgattttttaattgtatgctgaaataccttaaaagaaagaagggaataccttccctacaaagtacctactatttatacaactctgtaatctctttgtatccttgttgtttttaccaaaaaagatgtttcttttctccctttattttagtaaagtcttgcttatagcccacctctcccacactccccaccatatgacacacattgatcatttttcacttttgatggctagagtttagtccttcacaaatacaccagagtttatttgatcactgatcaatgagaaaacatttgagaaaaagatgatttgtttgaaagaatgaacttgtctataagtctcgtatattgctcatttctgtgtatcacagggtagttctgaagctttttacctgctttgaataatttctgtccattcttcctacttaacaaaatataattcattttctgacagccaactcaatttgtttgtcagtgtcttcctggaatttaaaattttcctccaatattaggtaaactttcaggtgattcattttaaatgagaaataaaaattatatatatttatcatgtattacatgatgctttgaaaggtatacattatggaatggctaaatcaagctaactaacatatgtatcacttcacatgtattacatgatgctttgaaaggtgtacattatggaatggctaaatcaagctaactaacatatgtatcacttcacatatgcttttttgtgatgagaacattcaccattattgtacaatagattcttgaacctgtttcccctatctaactgaaattttgtatcctttgaccaacatgatttaaaaaaaaaattctgctgccttgctggctttaccttaagctctgctttctctgctttattttttctataattcctgcatattgaagcaactttacttttataaatactaactaatcatattaaaaatctagtactgtctaatgtatttagggttaaagatataaatatacctatgattattggaatgctgaattatatgtctatatatgtctcccttaattttacactacagtgttaaaatagtatctaaatctaatcctacttttaggaatacctaacaaaaaattcagccattccctcaactctgttgaaagctctgtttctcactaaagcctatattggctttagtgaagcaaaataatttaaaacagcccaaaatgcttttttaaaagtatattttaaatactgtaaaataacaaggaagtatacaaaaactatttatggataaatggacttgtgattggaaacattaatatcagccaaatttccaaaagcagtttcacttaatggctgaaataaaatggagaaaaatgtatgaaaggttgcctaacaaatagattaggcataaatgactaaaaatgaatctgaaattttaaaaaaatctgaaagaaactgaactgctgaaaatatgcattgaaagttacaaagcagtcctagtggtgcatggaaatgaccagtatataaaatgccaatgactgaaaatacggagttttctctccagtatttgtttctttgaccaattcatctagagccaatagagtactgtatccttaataactggtattgcttttcaggaaaataaaatatgacataccatttagttttattaggaagctaataggtgtacagggttttcattgctgataaggctgaacattttctagtgttcctttcttgttggtgtaatgtttttatatctttaaccacttatctaggggaaagtagtattaaccataagggtgtatcagaactttattattttctatattaagttatttctccatcaaaatcatggctacttctatctatattgctttccttttaaactttttaatttttaaatgtacttttattgtactgcctctataattgcaaaatgtactttatgtagtcatattcatcacgcataggtgaccatttcattttttgctttggtattaatgaatttctctcacacattgagtgtaaatgcaacattgcattttcttacagttcttcataattaaaaaaagcttgaatccttgactcatctggaatgaattttaattgtttccccaataacatttattaaaagtttttttccccaatgagccgttatttctctacactataatccaaaaaggttatgtgaattctttttccagtgtccattctcccacacagctgaagttgcttgaatcttattctaatttctgatttcatggttaatgcattcccctgtctctgagccttacacatgtctttctttactttttaatctggaaatccaacccttatgctacaccccaaccacaaaatgatgatcaaacaaacaaaactacatgttgaaattgcatcagaaaatactatggatattttctttcatttttccatgcctcagctttagcatctcagtcttagcaggtttttaattatatttatttacttatttttaagtgaagttttaaagtattaaagtcaagtctttcaagattcagcctttaaatctaaatattactaaatttattcctttctactactagcagccagactcagcagccattgaacctttttttttttttttgagagtgaaaagcaaaagaactcagagaataatgtatttggactacaattaattgtgtataagctaaatatgaagctgaaaccaatataataaaggttctcaagattcaattcatcagactcttagtggcatcattaaggaaatcagtttaagtcttcacacccagtgtacttttgcctctgagtcttaggactttgtaatgcttctgactagagccagtcagtctgtattggaggggatctgggggcgattatcctggctttagtggcagttactcttttcccttttactgccattatcaaccctgctcatttcgtcctctgttttgccctgctaattttatgctgttttgcaaagcagcaacagagacaaaacattgcttttaatgcaggtggcatttaggggaaaaaaaaaacagttggaagttttaagaataaacattataaaatccctttgaatgacttgaagggcccagggtagcataaatgtagaggagccttctgcccctgatgggagacttgtaatgtcttctttcaggatttctttttatattccaacaaatagcatcatataaaaccagactgaagaactctttttttttttaattcaatcaagggccactgacccgctgaaaaaaattcaattaaggttgctgagggggaaaaaagcaactgttacaaagtaaagaaatagaacttgttcaattcatctggttttaaaattaggaaaagagaacataaaccccccttttcagtaaatgcagcaagtaatttacaagaagtacttcagttttatgttattggcaattaaaagagaaacacaggagagagaaaaaagaggagtatactgagttacatacacataaaggctagccccctcttaagaggtacggctctagaatagaagcaactaaataatgccaaacgttgctattgaaagcattctaaaagatgcagtgcaagcttgtgtgcgtgtatggaaaactattttacacgtttaaaatggcaactatatatattattgtccatctcttacaaattcttgtctttctcctttgtttctgtttgtgtgtgtgtagagagaaaatattttcacattgcttttatcactgggatacggttttttgttattatagacttttccaactaatgttattttgtacattcatttccatgtattagtgtgctacaaatacttattttaatagctaaattaaataatatcacatagattccttgagatcagagactggatgtttttcccccagcattattgtggtataactggtatacaaaagactgcacgtaattaacattacaatttggtgcagagactgcatgttttgttcacgtgcatatcactcaaaacaaatgatcagtgagtgaggagaataaatgctacatcagagttggttcaatcacatctctgggattttaaaaataaatcatgaatacagctgtgaggaacatcttttgtacaagatggaagatgagaggtctatttggggggacaactgttctctgaactgggagtattagctcagaacaatacagttggtatatgctgtagtataaacagtttgagtatcttcattatccacatagccccacagttatttggttttctctttatttttttactaacacgatgagtgaatatggtacttcatactcatttacttgtgcttcattttattcattccttttatacaaaccatctgcttctaacctcttgttctgaggaactggcattaactttgtatttagatgggaagctttttgtgtgtcatattgtcatactacagaggtaacattgacaggattcagcaagtgtccaggtggaaaggaaggcctaacctgttgtcctctttgccatgcttagtctccacagtgtatatgtatacagggtaaaatatatatgagatatattaaaatatattaatatacataatgtattataaaataatataaaatatattaatatacataatataatatatattaaaaatataaaactttggtggttgctgctgtggtaaaagggatttctgcccttctaattgtattcagtagatatttattgttggagtgggaatgcaatagatttttgtggttttataatttgcgcctttgttgaactcattatttttaactttgtttatcaaacatcttggccttttaggttatgtaattacttatatattgtgcaaatggtgttgtttttattttatcttcttacattactcatttatttttcctacttgcttacaatggtcaacattttctaacacagttaattaggaatgatgattggatatctttttggggtttttcttctttattttagatgactacttctaatgtgtctctcttaataacattgacttctttcagacatatcatatttgtgataataaaaaatcctacttttaaaattagaaacaaatgttgaatttttagattttttaccctatttattcacttaattgtgtttttactgtttttcttatgaattgtctttatttaaaatcagccatgcaacctcagactaaaatccaactgatcatgacaaacaattcttttaaagtgttgatgtatagcttgctaatattgtatttagaattttgcatcaatgtccagaaataggaacaatctataattttccttgtgagattttagccatagatcaggtttagtaatcaagctgaccttagtttcatgaaaataagtttgatagaacacttttaggaaccatttgtactgtaagattattatttatttaatatttgaactgcttgtgtcttttttgtttcttttgaagtttgttgataatattgcttatttcttttctttctttctttctctctctttctctttcgttccttctcttcttttcttttttgtttttttcttttatttctacagggtctcactctgttgcccaaagtggagtgtggtgggcagtgacataatcataactcgctgtagtctcaaacgttggggctcaagtgatcctcctacctcagcctcctgagcagctaggacaataggcatgcaccaccacactcaactatttaaaaaatttttttttgtagagacgggatctcactatgttgcccaggctggtttcaaactcttgggctcgaatatcctcacaccttgacttcccaaagtgctgggattagaggggtgagccaccgtgcctggcaatattgcttatttctttggtatatttagattctttctctcattttgagtacttgggctgttttttttttgctgttgttgtttgagaaacttactcctttttgtgatttgtggcatatttacatatggaattccctaatgatttaaatagttttttagtaagtataactaaaatatatctttaaggtgaataatttgtctacttttctcctttatttaattgtactggcagtttatcaattttattcgttttttcaaacttcttaatacaggcgtgtagagctatggatacattttgattccttgattgtattttaattagttctttattcagttgccatttaagaaagatatttttatgatttctatgtggttggattgtgttcttatatcccatttcctatcttactgtcttgtgctgtgtagaaatcctgccatttcatattgagaatgtctttgtgtttgactatatgacaaattattgtgagaaagaacattttcccaaatatttttacatgaatcaaatcatataaacctgatgattatattgtattgtctggtttagatatactgaattctttcattgttgtttttgttgctaatttgattcctcattcagctaatggaataatctctaggattgtgtttgtctctgtcgtattgaattgatcagttttttgttttataaaaaatcattagatctttaaaaatttactggatatttaaaaaatcacttcctgtttcctttatcattttatagtgtccttgtgctttggtttaagatgtactttttttcagattctgtgactaatatcttgctctttttatttgcattaacaaacttaaagggagtaaccatttaattaattaatttgtttacttttcaaatacctagagttcaaagagagagtaaccattttaaacatgtatttttataactagagtcagattttattaatccaatttctaattaatatttaatacataaaatttagcattataattatcttacatttttaacttagcagtgaacttttctttttaaattcatactctagtaaatttgagggatgatttaatgatatgaaaagataaccttaatttcttaatttatcttgtggctttgattccttttagtgctgtgtgcaacactttcttttatttgtaataatgtattggttatttgccatagaactgtagtctttcttaggtagttgttaggccgtccatcttattctatttgtttttcttgtggtctttcctatgttatcttaattgatgctctcttcaccctatcatggtgactttgcttatctacttctagtattgtaaagcttttaaaattggacctggcttacttcttaaacaattacagtaattgagtcctatcgtgattattttttattaataatccttgttattcttccagattttaaaaaatggtgtatttaatttcaaaggcgccatctgcccagatgtctggcttcttgtactacttttttaagtcattttctttatttagtaacaattaacatgttttaaaaacgcctacatgaaattttctttcagtgacatgaaaataaattgttttttccttagctgaacgtatataaagatttatttgtctaagtttctaaaatcttttgggtctttcaatctttatgttagcagatatgatatttagcacattcataagttgtataactttcagatgattaagagtttcctttgtatgtatggcttaattttccatcatttctcatttttaatatacaaaaaatgtcagttattgaagaaaattcttaggaatctaccttcctctttccactagtagattatttccaaaatgatgagttaaatgaaaaaattaatgtttctttactgtgggacttctcatggcttttaatccatttgtatgtttccccaattttttcttgatcatgggacaatcatacttcattttttaaggaacacatagaaacctcttatagaaccaagtgttacataattcacagtttagaaaatgctggtgtaaggtatatatacttgcttttatttagaagaggctgctgaacttgataatcttcaaaaacagaagattatgtaataaggaaaaatgcatggcatgttcaggaacagttaacgcaggtgtagaataagccaaaagcccaaagcatcagaatgctgatgagggaattagcttatattgcccaacacattttttgaaatgacatattcttattctcataggtactcccatcccaccttatattcctaaaatatttcattggccaaagtccattgacatcacctgtttattgaaatttctagaagtatgacctctttttaggagactgcagccacatagttttttgctatcttctaaacttgtccaaagttgttggtagtccccccacctttaggtcaagataacccctttggagagtaagcagtacatttctcatagaaggtggatggtatcttatccagtaagaccatctctcaatcagatttggggagaagtttatctgtatgttcttttagaaaattactaatagcaacacacttgtataaaaagtctattaaatactgcttattaaatccctaagaatcaacctctgacaggtacaagtatggcaagggggaaaaaccatattccttcctataagatacccttggaagtacttatgtgccacaaactgaatgttcacagaccactggtgttgtaattgtcaactttatatgatggtgttttcaaggcataataaaacattcttcctggaagtcccctaaacagagggggcatcttaattaggctctattaaatcttgggtaacatttctgttgcctgtgcctgtgaaagggaagcccagggaagcattgctgtttagacctttacagaatggccctcccctcaaccatggtcctgtgcaagcggctattttaatatgctcactacagtgcaaaggaatcccagggtagaaatgtgatagattcatttgcagattatacagacttgagttttggcatttaaagtgatgcttttacaccctttcctgctttctatggttatacccctaggccccctgacactgccgaaaaactcctccatcctccaaataattcagtgttttgagtcccctgcattcctcagtagtctgtcttttcttgtcattctctgtcaaggcttaagtttctcttttagagaagcaaggcctttttatgtctggcctccagcaagaaacctcagagtcctgtttttccttttttacccccagaaagttagcgtatctaagctttgccccttgttctccagtgctatattgtccatcacccaggccaggggtgattccggttcagcctcctcaccactatttccaagttactctaatccctttagttcctgagagattgttctcccttccaatcaaacgcaagaaactgctgccagactctgccctataaaataactgcattctttatgtgacttccttatttatgaacctagggtgactttccagtgcttattggctccagtataaattcttctgtgtgcttggatttcaagtccttggtaatcttgcctcacctcatttatccgtccttacctcccccggctctctatacacaccctagcccctcgaatgacagtaccaccactctttctcaaggcagctgtgctgaaagacctgctcttttaattttttttaacttgtaaactgtcatagacagatacttttgcaaagtacaataaaaatcattagaagaagaaaattataaagccatataaaatataagcttcatttttattagattaatgaacataaaattactctgtcaaattggtataaaagtccctaaatgcttattagtttcctttcttatctctgtaaacactgataatatggagtgtgggggctggcacctgtccttgtgccatactaggagtagcacagctttgccgcctgttcgttcacactgccttgccttttgcttggactctccctgtcctagcttggaatgccctgtctttttcagcaacctcacctgcccatgctagagagccccaggtgggttcacgctgcaactatacaaggctatacttaatagaccccttccttgaactcctgctgctctacttacacttaatatcatacctctttttttttttttttggagacaggttctctctctgtcgcccaggctggagtgcagtggcatgatcgtggctcactgcagcctggaactcctgggctcaagcagtcctcctgccttggcctcctgagaagctgggaccacaggtgtgcaccaccacatgtggctaatttttttaaaaacatgttcgtagggacggggcctccctatgttgcccaggctcatatttttatttttctataattgttccatctctgttagtcctacccactcaatgcctttgcaagtagcctgagatactaaagggtataaagtgtgtgtccttcccacaaaaaacgtattatatcctagcacctagccttttaagtcccttgatacatattcgttaaatgaataaatgaatcttctatccaaataaaaatatgtttctctcctccaaaagatgtgtcttctataatacatagtaggcacttcattaaaacatttatttaaaaagtatattaagttgattggttatagtttgggaacatacagagcacctactttccaacattgccctgtgacataaccttttggctactgtatggtgctgactatggcacaggttttggtttagtgcctttcatagtcatttttctgcttattcagaccagttattgccggatctgattttatggttccatggagtgtcacatgttgagaatgtgaaactttaaaaattgttttctgtttaccccaatttccattaacattcatattcacatgccatgcaatgtttttttctctttagaggttagaggaacctttaagagagtattacagttgcccaaaatttggaaattgctgaattaacctgtttcaggttaagtggttcagtctgcacactccttgatcaatgaatcatttctccgttatgtacttagtttcagggtcggtaattaataagcagtggcatttccatctcaaccagtgagtttattccaaattcctggaataagcatttgtatggcaaggtgggtattttcccctttcatttatttatttatttataattgtttttcaatagttttgggggaacaggtggcatttggtaatgtggataattttttttttttaacagagtctcgctctgtcgcccaggctggagtgcagtggcacgatcttggctcactgcaacctctgcctcccgggtccaagcaattctcctggtttagcctcccaagtagctgggcttgataagttctttaatggtgatttctgagattttggtatacccatcacctgagcagtgtacactgtacccaatgtgtagtcttttatccctcactcccctcccacccttccccacaagtcaccaaagtccattgtatccttcttcttcatcttagtcttcgtcttggctctgtcacccaggccagagtgcagtgatgcattcttggctcactgcaacctccacctcccaggttcaagcaattttcctggcttggcctcccaagtagctgggcttacaggcacccgccaccacacacagctaatttttgtatttttagtagacatgagatttcaccattttggccaggctggtctcaaactccttaccttaagtgttctgcctgcctcggcctctcaaaatgctgggattacaggcatgagccaccacacccagccattatatcattcttatgcctttgcatcctcattgcttagctctcatttataagtgagactatatgatgtttggctttccattcctagtaactttacttagaataatggtctccaactccatccaagttgctgcaaatgccattatttcgttcctttttatggctgagtaatattccatggcatatatgtatatgccacattttctttatccacttgttgatggatgggcatttgggctggttccatatttttgcaattgcaaattgtactgctataacatgcgtgtgcaagtgtctttttcatataatgacttcttttcctctgggtagatactcagtagtgggattgctggatcaaatggtagatctacttttagttctttaaggaatctccatactgttttccatagtggttgtactagtttacattcccaccagcagtgtagaagtgttcccttgtcaccatatccacgccaacatctattattttttgattttttaattatggccattcttgctgaggtaagatgtatcacattgtggttttgatttgcattttcctgataattagtggtgagcattttttcatatgtttgttggccatttgtatatcttcttttgagaattgtctattcatgtccttagcccactttttgaggggattattattttttcttgatttgttcgagttctgtgcagattttgtatattagttctttgtcagatgcatagttagtgaaaattttctcccattctgtgggttgtctgtttactctgctgattatttcttttgctgtgcagaagctttttagtttaattaagtcccatctatttatctttgttctccttgcatttgcttttgggttcttggtcatgaactctttgcctaagccaatgtctagaagagtttttctggcaaggtgtttaataatgctacaagtttagccaaaggatgtcaaggggttttaaaactttcctgttaacatataacacacctacaaaacagtgtgcaaatccagttacagctccatgatttaccagaaagtgaagacacccgtgtatccaagggtggtgagaatttcactgggaactttctttcctttctttcacagccccagcgatgtcttcttaaacatatggcgttagtgggtgtgtatgttatgaagtgtaaatagtaatccatgtgcagaggtgctgctcagttgaatgaattaagcctttgacttgtctcattgtcctgagagcattgacgccatctgtctggcagcacaaattctgacaacagcccaaatctatagggtctttcagttcatttatttttttaaaaagctttccaggtgttttgaattatatttagttgtggttagtggtaaatttatgagctggctggctacatcttcttgagttgtgccatagaatctgcaaaacggtcccggggtctctctcttggggtctctccctctctttttttcttttttttttttttttgccttccaaatttcagcttggaaaaataacaaaaatgttctcagctccccattttcccaccattactgctttctttcagctttcaagggatgaattctgacatgcagtttcatgtcctaccctaggattatacacaactctcataaagtacccatggctagaaaatctgcctgttttctccttaaaagccctatgtggtttgtagggctgacattttaatcattacccctgttaaaattcccagtgactgtccaggtgcatcactggcagaatctccaaaccaaagtttaggaataaaaaggaagaagagaagaaatacttaaatattgtacttacagtttgtgttgaggaaaaaaatgcttacactgctaaagtctattgcagcttaactaacacttcgctaggacaatatgctgagtgttcggcatgttgttttctttattttttccccctagcaataatttcttaactcagtgttccattaaccttgaggcaagccaagaacttttttaggatgcttttaatgcaagtaatttacttacccatatgattaattaagggatatactgccattataaaggtttgcatatatgtagagctataatttttccttggtttataaagtagtttataaagttctgctgacccataaaaatctaactgttgcagttactgttaggcagagtacagtagggtgtgtaactggtgtgctgtcatttccttgagctaactagggagaacttgttatttggtggctgggtgatgggttaagcaatacaatagtttaagcagatttaagaatccagcaggacaagttaggaagtgagactcctgtgaacttctggcattagagggagatgtgctggccccagtggatttgggtctcttccttccttggcttgagctgtggattctaggcatttaaggtttcctccccacacccaccttctccaccaccaaggtcaacctcagagcagcatctcctaagagacctggagaggaagggtttccggttgtccttgctttttaatttaagggctttgtttaaacctgaattcaagggggaaaaagcagtttttccacatataagggaagtatctagctggattttgtgctcttttgttactaaagttctaaaattgtggacttttagtatcctgtgatatgtgtttttcatgtgctaaattccaaagccaggacaggagtagggagggggtccagagtgtcctttcgttggctcttccagattcaatgtgtaatcactagggagagaaataagagcagaggttttacagtaaataatatagtttgaatggtaatcatcatataatccaaaagcatttcttgagcaactattgtgtatctagcattgtgaaggagggtctgagtaaatttgcctgaatcctggttctgttgtgcttattattcaatgagaacacaataaagtagtgagtggcattgtcctaagggagtttaggaaagggaaaatatcatgaaagaagtgagacttgagctagcctttaaagacagttaatatttgggccagtctggcccagtaacacaagtctggttagaggtgggtgtgggggctgaccatgaggaaattggcttgacttgagaagagatctgtggggcagctgggaagcagggcaggggagttagagatggaatgtggccaaccacagggaatggccttggagagtaataacctaaggaaaaggccaggacatcagtgagaaaaatagggatagaaagtaaaggaataaatacaaaatactgcaaacaagaaagtttggacttggtaccaaattaaataccggggttaaaagaggagggagcaaaagagaatcgacattctaagtaggtgacatcaaaatagcaattgtgatagcagagaatttggggagaaagaaatctgctttggggagcagtaatgtgtttaggtatgtttttcaagtgtcaaactttttatttggtggtaatttaaaatatgctgtggcttgaatgggagagcaggaatagatttttagaatttggaagttatttgagaataatgatgtctgtaacccataatagaattcagagaaaggtgattagacagatgtatggtggggcaaggtggagtggtggtggggggctagccacaataggaaccttgaggaaggaagaagtggcaacaaatattgaaggaaggatcagagaggtagtaggagaaccagaatactgtaccatataatataagctaaaaagggcatttcaggaattagggagtcatcttatgtcagatgccaaaagaagaaattgaggagagtaggaagttaaaaatccttttagctgtattaaagtctagtatatattaagcccatttgccatgcaaagttagaatctcattataacacaacctgcaatagtacagaatttgatacactcctattcagttttgtgctctattccaagaggatagatattcctggaagcatcttatccatgactcttctgctgcataaaccctagggacagcataagatagaagtttatgcatattctcttaacagatatacagcaggtcacagcagttaaacacgattgggtgaattcttccaccaagtttcagcaggctttttacccctccaaacaaatattcatatcaactttggtatgatgcaactaagatgcagaaacattagcctctcgctcttgaggctcaactcaagtcagtgaaatggggttggaactataatccggttccccagattgtctaatttgtttttttcttctctaacccattgagaaaataaagattaaccttcaactcaatatatcttgcctcctggacctaaattcagatcaagacgtattcctaagcttacattttagaattacagagtaaggtgtaggcggcatttgtcattctagtagtcaccacaccttaggtgggtggttgggcagaacagtgactgaaggatggagtgtgtgtccctaaacccgacacgccctgaaatcttcctgaattagtaagtcactttatccatatattcttgcacaataatggcgaaggggaagtaatttggatagctgctgataagacatttttgggcccgtgaaatggcaatacttcaaacagaatgggagtagctgtactaaaccaagcaaacagaattctttcgaaaatagttacggagtttctaccttgtagctgaggcttccgagcaagggtaaagtcagtcccttccctctgggagagataaagcacagtgcaagtaactggaatgcaaggcaggatgtgtctaagtgctatgtgagcgagtcatagcagagacattcttagagtgggttcttggaggaaatgtagagtgtaaaggcttgacagctcctaagaaaagcatcaatgaagagataatgaacctattcattctgccaatctaccaaatggtaagacgtaataagtttatgtagcaaatgaatagtgtaactgtgtctatttttacaggggacttgagctcatgagtaaagtccttccaagttgtcatttttgtttaaatttcccttgagcaataaagtaaaattcattcagctgccagttttatcatgtgttatgtactggctttagagctggaggggttgggaaatatgagagtttcatattaggagcaccagcacaggataggtagcttgcccaggatgaaaagtagcaaaataaatgccttgttatccacgtggcatatggcattctgttgtttagtgctttgcaatacagtgtggccatttcagtgaagggtgctaagactccagatacctaagtcttggcctaagccattatctatctctgtgttagtgctggaatccttggcattttctgacataatcatgcccaagcttgattacccaagttctgtagattgttcaaagtgtcccttgtgcttatctcatctatcagctcagctgtcatactcattcaacccttgtgccgaagactgtgtaagattcatcttcataaaacaccacataggatgaattaccagtttctgctcttgaaatctattgaatcactcctcactccacaccccattacttcctttctgttctcacctctactcagcctagttcaggccctcctgaactctctcatctgtcagttgtgagagctgagcttttaaattgatttccctggtgcaaatccatatttccacttgctgctagactaaacttcctgaagaagcattttactctccaacttataaaactttggtaactgcccattgcctgtagctctgttttgcagcatcgaaccccatgatatgcgttactgtcttcacagtcttcatgtccatctggacttgttatcttcttttaaatcagctcattttaaatattaaaacatgtattttaaaacatgtagcctcactgcaagcaataaactccatgcaaacatgagtcagggttagttttaatgtattcctctttacagtcaaatggacacattaagtaagaggaacaacattggtgggccacctaaaattccctctcctaagaggttgctcaccacactgatagtccacctcattattattattgcagcatttaaggaccacagcatggccttgaccttattcaccctcttctctctgtcagaactctccactccagccaaactggtttctttgtggcctccttaggtagtaactttatatattctccttagcttctgaaatacctttctctacctcctcctcctcctgatctgtgtttgtcttttccatcccctttggtcactcttcactccaactcatctcatctatagcagtgcctccccctctctaaattcttgcattttgcatcactgccttgtatcagtagttcagcattttcattttatctggcttaattctgtcctcattgtatcatacagtgtcagagttaagatgtatctcagagaacttttcataggactcttacttgatgtagacccttgaagctccttgaggacagcaatcacattattcctatcaagccccaaatgtgtgtctctcttttagggtttttcttactccagaagtcattgaatacaccattatttcaggatttttcaggagttatttatctagctcattctgctgatcagcagtgtttccaccagagatgtcaaagtcatacctttattatcttgccccccacttgtccctgttgtaagttcccacccttcacaccttacctcaatacctcctcacctcctgacctcatacattcagtcttcctagttttcaatccattttgttaccttcttctttacttccaaataataataaactcttgttttttgagacagggtctcactccattgcccaggctggagtgcagtggtgcagtcatagctcactgcagtcttgatctcctgggcccaggcaatcctcctacctcagcctcctgagtagctgacactacagatgtgtgctactatgcccggccttttttttttttgtagagatggggtctcactatgttacccagactgggctcaaactcctggctcaagtgatcatcttgcctcagcctcccaaagtgctgggattacaggcatgagccaccatgcctggccaataataaacatttttttgttgaagatcccatctgtgtctatctccctagttctctctttcttttacccttagccccaagttgttgaacataaagtctggaactcactactctttagcagttcctttctggcctcagacaagggagaagctaaacagttggggtcaggggcattcatgaggatctttgagtgatatttccctagagaggcccattttcctgttgctgatgctaacaaagatagttaacatttggcactggcagtgtccagacactgagctcagcactggtcatagtgtcctggttaatccttgcaacaaccctaagaatcagggactcccgccctccccattttacagatgatgaaatgcaggcatagggagattaggcacagctgttaatggcagaaccaggcattccaaagctgagactatactgtactgctcaaacgacacaggtgtagaaggtgtatggcagcctgagccccatttcctgtttgcatattcctgctcatacatgcacaggaatatatacttaatggggtacggtcactggacccttctcacttactctctcaccaccccctctgctcctgccattttgtgggcacccacatagacgtagtgctgcaaagtgagcctccttttgagcagatccacacaaaatgtgcagataaacaagccttctacctcaggcctgcagcacgcctgctttctgacctgcttggtacgtttcgggcccaaagtgtcagagtgtggattttcacaatccccctcccacattttaagtttgcaggcaaatgaaccttaatgtgccttctctacttccctccctccctccttccctctcacactcagagtgccagaaagaagaacctgctgactccaccactcgtctatatgtcttgactgtaggagagagagctttcctgatcccattcctatttgtggagtctgtgggagagcaagccatcttgccttcttgttatttctctccttcacccatgcatgacactgcaaagggtttgctggcttgagtcttctacacacacacacacagtctgagacatctgatgtgttcaccctcccatttgccttgaatggtagtgtgtgtgttttttaattccactcttatatacacaacttacaggagagtgaattttctagtgccacccccccgccataggctatgtgcccccttgctttttttcacccagcatccagagtcgagattgtttagtgcccttcttacaggccttgttggcaagagtgagcattattatgggacaccctccccacccccgacacagatgatgcacacaggagtacaagatgatgaggctcctgatcaccccacgcctccttagacctacgtctgtgtacatcctctgtctgtgagggagagaggaggtgactccttacctgtttgtctcacatgcctcacacattggggtgtgagctgtttcagttccctcccacacatgaggtttacagatgtgcaagctttttgagctgtgccctgccttttaaacccagcatgccttcttagtgcttttcccacaagcatgcattattggagagtggactttgctttttttttttttttttaacttgctgagttgaagtatttgaaggatagtgggcctaaaaaaactggctctggcacaggcacatgtgccttcacatgtgtacacacatgtacaccacgagggagatgaatccttcggcctgttagtgtttgctttgtatggtagatgtgttgaggaataaaaaaaataatctgccccttttagctgaggggaaaaataagttcagaaatggcagttgatccattaaggatggtgggcagtttctaagctatactctgttggccagcaagtttaaagactaaagaaaaagtgtcagtgtgaacacatatttggctcttttcactatagttggtgttgtcaagcagctgatacctgcggaatagaatatgagaattgtgctacaacgaatacatttgctttcttagtctgtacattaaaagcccctttttttacttgttttaaaggttgtggagcattgtttgaatgacaattatttacattgtaaaaatagtatgaaatttatgatattttaaaaatttgctaggattcatcagtgagcattcttcctatatctgccctgtctctgctctccactcccccagctctcctgccccatgcaggggtgcaagcctctcaagctatcccatcccaccttgaccacacagaactacagtgagctttttattttaaatatgcttccccaaacctgttggactgtgggtttccccatccgcctcctgcttgcagcctctctctctaatcctgcttttctctttctttctctcatgtgcatacactcatgatatgcatgtaagggagacacctgagttgccccattgcatccagcatcgcaggactgtgagccttctattgctgccactctcctaccccacgcatggcttaacctaaaataaaactgacctcccaattgggaggttattacaacctcccaatgcacacactggctgggccacagtggcgtgtgaaccactgtgtcagccaccttattaccccttttctgtgcatgcccccacacacatttatgataggagcttgagcctccttattctccatccttgctctttctctcttccttttcctccctcatctcacatgtgtgtgccaaggatgtgccagaaagtgggtccttatcattttcagttctcatacacatgtgggtacacacagctttagggttcagtggttaggcccactgtcttggtagtcagattacctgtggtagaatcctggcgtgatctgtaatgagctttgtgatcctagacaagtgacttatcttgtgtctcaatttccacaacatgaaaatgagataactaattgtgccaaccatataggtttgtaataagcactgaaggaggcgacgcatgtattgggattaacatgtaataaacttccttaatccatatgctttgcctggagcaactgattctccatagaagaaaactcacacctaagctgcttggtcccattatttgaaaatgtttgggaagtactgccttggatgactgtttcataattctttcctttcctcaaatctgcagtgtcacctcccttccttcctcctcactctcagctgctgactttgctttcttcttccttgagaaaatggaagccatcagaagggaccctctgaagttcctctgacctctcctccattacctgcacatgtccctaagtgtcagctcctccccattatggtagatgaattactggcacatgtagccaggaccagttcctccacttgtatactagatttcaacccctgtcacctattcagtgacagtgctcctgcaattgatccccctctccttactgcatcatcaactgttctttgtatactggagtgtttgtaccaatatctagatgtgctgccacatatcctgtctaaaaataattttaaaaattaaaaagcactaccttctctacccaaaaagctcctccagtttctactcatttctctgttcctctttacagaaaaaaaaaaaatttttttgaaggagctgattgtactccatctctacttctatttctcccatttactcttttttttaaatgtatactttaagttctagggtacatgtgcacaacatgcaggtttgttacatatgcatacatgtgccatgttggtgtgctgcacccgttaacttgtcatttacattaggtatatctcctaatgctatccctcccccctccccccaccccatgacaggccccgatgtgtgatgttccccttcctgtgtccaagtgttctcattgttcaattcccacctatgagtgagaacatgtggtgtttggttttctgtccttggatcccttccttacaccttatacaaaaattaattcaagatggattaaagacttaaatgttagtcccatttactcttgaaaaccctccatgtaaaactgtaacctgcagcacttaaatgaccctggtcaaggtccccagtgtccttcacatttcccaatttactgggcaatgttgtcatcttacttgacagatcaacacacagttgatcactccctctgccttgagactctacctgctttccaggattccacactcatgaggttgtcttcttacctcacaagcctctctttctcagtctcttgatggtttctcctcctcttcctgaattctaagtattaaagagatatagggcttagtcttcagacttctttttttttttttaacttctcattagtcctcagctgttctcatcttgtcttgcaactctaagtaccattttatgtggatgatttctgtgtttgtatttccagcctggacttctctcctgaattccagatgcctatgtccaactatgtactggacatctgccccgaatgtctaataagtatctcaaaactttaacacatccaaagctgaggtcctggttttcctccccctctcaaaaagccctactcctccctctgtgttctccaactcagcaaacagcatttcccaattgcatatgccaaggatatggagaattttaataagctaaaggttttggattcatctttgacactttttcccctccattctccaaatacaaactgctgtcaaatcttgttggctctactttcaaaatacatgtctaatctgaccacacagccacttctcatacttctcacttcctctattatttccacactaatccagcttttccctgggctgacaagtgcaagttctcttgcgtctgtctgtctgtctgtctctctgtctctgtctctgtctctgtctctctctctctctctctgtgtgtgtgtgtgtgtgtgtgtgtgtgtggtgtgtgtgtggacacaaagtggttggtggctgagagcttgagcctccttttttgagtcctctttctaatgacctgcatgccagattctaagctttcttaccatctgttctcgtatgtgtgttatttcatctgtaaaatagggataatgatcacctcatggatattttatgagaaataaatgagctatgtgtgaaaagcacttaaaacagtgctctgcaaatgtaaatactatactggtgttaggaataaaaataaaggaaaagaaagaaggaaggaaaacaaatatgttgtagatagtgaacatttctgaaggtacatatgtgaatgtacacaagcacaccttctcattacagcatgtctggggcacagtcatagaagtccaaggcatctgggatacgcatgcacacagtatacaggagagcagacctcccgacttgctttctctcctccatgccttgagtgtaggaccgttggcatcttaattaccctcccacacccaaggcttgcaaaaaagcgagccttctcttccctctccagtgcataggcatgagcacatggacaggtacaccaaagggaggtaaaccctctcttacgtgctctgtatgtggggtacactgttagcagccatcccatctggatgactgtcctgcttccatggccactgctcctagtttacccatcagcactcctgtggctatcttgctgcccacttgcaccccccaggccagtgcctcttgcctcctagagcatacccatatgtcgtgccaagagagcaagcccttccctgctccctctctcacatcccttgcatggtggagggtgagctttctgaaaacccctcccacatgcagggtttgcaggatggcgagcctcagctttccttgctctcttgtgcatgtgtatatacacatacgcactccttcaccaaaagaaaaacacacacccatgtggtgggaaggagaatgactctcagccatgtcctttctcccatctcagtcttacatggatcctgcaggagagggagacttctcttagctttctcttgcacatggtgcagcccctcatactcagggataggcacagcctagagaaggaaggggggtcttttgacctggttctgtcttaccggcacctagaggaggagagagaaccttctcaggactcctgtacatggggcatgatgaaaagggagtcttctagctaattctcacaaacccagtttgtgaggaaaattgtgtctatatcataaccatatgcaaagatgtaatatgcacacacattttgggttcagaaagtaaaatccactcactgtgccatgcctttccatatgcacacttgtttgctcaagagggtgtgtgaagatctgtcttcttagacactcatgtagatatgagtcagattgtgagttttctctgttatctccccagacccaggatttgcagccgattcatttggtgagccactcattcattcagcaaatatttatcgagcagctactgtgtgttgggtactcccctatgcaccagggatacaccagtgaccaaaagacaagaatccctgccctagtgaggggaggcaggtagtgaacaaaataagtaagtaatagatagtgtgccaattgttgataagtgctctggagaataataaggcaggaaaaggggacaaggagtgggtgggggtagttacagcatagatggtggtggagaagtttcgatatcaaatagggtagtcaggaaaggcctactgtgttctaggaacaacaaagagccattgtggcagaagcatagggctgggaagtagtaagttacaatggaaaaagggaaagctgataattactatgtatctctaaaatctaaggccgcttttaaaaaaaaaatcataccattatcacacttaaaaataattaccatccaggcacaggggctcatgcctgtaatctcagcactttgtgggaggctaaggtaggcagatcacctgaggttaggaattcaagaccagcctggccaacatggtgaaaccccgtctctactaaaaatacaaaaattagtcaggcctggtggcaggtgcctgtaatcccagctactcgggaggctgaggcaggagaatcgcttgaacccgggaggcggaggttgcagtgagccaagatcgtgccactgcgctccagcctgggtgacaagagcgaggcttcatctcaaaaagaaaaaaaattgccaacaattttttaatatcatcacatatctgttgttcccatttccacttgtctcagaaatatcataaattaggatccagataaggtccatgcattgcatttggttgatatgtatcttaagtccctttgaattatatctttcccttccatctatattttttctttccttataatttatttgttggaagaaagtgggccattcatcctatacagttttgcatagtctggatttttgtgatcacatccctgtgatgtagtttacatgttccttctccttgtttgtatttcctgtaaactgatagttgcatctggaagcctgatcaaattcaggcttaattttgaggaagggggagcaaaactacttccattaagaggcacaaaataactgatgatcatctttctgtgatgttagttgccaccgatgctcaattcttagagccgttatttcattaggggttgcaaaatgatgatattctaatcccattattctcttgatttattagctggaatacttctataaagaaaaacttcccttcatctgctatttgatcacccagtgttgccgtctttataggcaagataggataaatgtttggttctctttatttatcagtactcagaataatgagttggttcactagcttactctaaagaggattttttaaaaaaactattataataaactcatagatttaaatatatttggacttttaatccattgcagttcttgccttcagtgaagctccagtgccccatctttagccagtaggagcttcttcaaattggttcctcagtccttttgacatgcctccgtagttatctgatagcttctccgctttcagagatgaaaaaaatgtacaaagctcatcgcagataccttccccaggcctggaatctgccatgtcttcaagaagccctggtttcttttaatcagacatgatatttaaagaccatatttgcctctggattggtcattgtatttaggcttctacaatgatcagaacagaaaaatgttttgtttttgtgttttcttgtttctagataaatacatcatgattccattatacttctgattcaaaatcaggattacagttttctgtgtctttgcttcacaagtatggttctgactgttgtatggcaaataggaggagaaagtgcagaaactgggagaccagttaggaggccattgaaataattcagttgagagatggatggaggcctacatcagggtgatcgtggtgaaggtagtaaaaagtggttatattttaaagttacagccagttgagtttactgatacattgcatgtgaagtgtgagagaaagaggagtaggagactgagccctctcttccctctttgtcacatatgagttgggtacatatgctgacactgcctctttaatctgtagcatccgcatgcaagtgctgtcccagtgcagtacacctgggctaggactcacagatggtatgttatgcacagagcagagagtgcctgtcacctctcctagttcctttcagagagctttttgaatgcctgttggatttggggatccaatagtggcaagagcatcagggaccctggttttactgtggggtgagcttgtgccagagaacacagttcatcattcccattcagcctgccttcatgtgttcaaggggctggaaaaggggagctttttctttcctaactcccatgctatccttggggtacaggtgcctgagccttctcatttgctccttctctttaatccttgatactggtactagtgctctccacatgcaatgcaccttggcagggattcagatggggtgagccttagctgcagatggaaggacagagcccttgtacatcgcctacctctcctgctgcctgccagtattatttactcctgtagggagccagaagagaacagtacagccacagtcccctgagtgtactgcctagctagcacatataggaggataaagctcatttgtactcactgtgcaggtgtgcacacatgctggggatactggagaatgaatttactttagttcccaccccccaagcaccccaccttgtcccccaggatggtcaggcatttagggatgtagacctgtatacacggagtcccactgatcaggtaagcagtgggtggttccttcctgccctaactctactctctttgccctcccagaaagggcagtgagctgtctcggcattcttcccttaggtagctgttgaatgaagatgcacttccttgttaatgttctctctcacaatcacagatacacaaatactcgtatatgcacatgtgcacaagcaaggcatacaggagaatgagcatgcaagggaggcccacatgtggctgggtgcccagcatatgcagacatgtgagcatacagggacaggagagacaggagcctttttgattatactcacagggccagatgcccccatctttactcattttctgtctctctctctctctctttctctctctctctctctctctctctctctctctctctctctctgtcacacacacacacacacacacacacacacacacacagagagtggaacttctgatgttttccttcatatcccttatgtgaaggggcgtgaactttgttgacctagggagattgaaggagaacctcatcaactcacacgtgaggaatttaagaggatgaatctgtgtatccccttgtgcaggcactcacactcacagatactcggacctcttctctctcacctgtcccttgcatgcaggagtttcaccatcccccttaaaaatgcacattcattcaaacacatatatacataaaaatagagagtaagaggtaaaaatattgacggctgtgtgccaggtactatactttatttcattttcttgacaccatttaagaggtaggctttaaattgtcctcattcttcaaaagtgtttaacttgaccttgggaaaatcaggtcgattctctaggctaatatgtggtagagcgtgcatttgaaccaaggttcgtaaataccaaagtgcctggtttttccactacattagtgattctcccagtgtagtccctggaccagtagcatcagtatcacctgagaacttgttagaaatgcaaattcttgggtctcaccccagactcaccaagtcagaaacctctgtaacctgtatattacccaggtcttcagatgattctggtgcatgttagagaacaactgtgctaaactgtactgccttcttgttgcatagtcacacaaagcatttgcgggatcatgagctttggcgttatattcattctctctttcctccctttcacactcctctctcctcccagtctctttataggtttatacttttttgttgttactatctgagagaacagacaaaatgtgtgtttaactagacatctttaatgcaaagctcaagaactgttctctttacttctatatcatgacaagtaagtaccttgtgtgaagaagaatgagccctctcactgaacattcacagggctttgtgttctgctccccctctctaatccttgctacctgggtgagagtgctgtctgaatgcaatgcacctgggcaaggattctgagagcgagagcttcatcttcgtgtaggacagagcgtctttctgtcctcctatcatccattccacaagtatttattgaccaccttttctgtatatgatactaagttgagtaatgagcatacagttgctaacaagacatgcttggtccctaccctcatggagctacagttgaggaagaagaatggaattcctcatcatccattacacctacatgccctgagagtgggtgggccacagagtggacttctcattaccactgtcacccacaaacatacacaaaagcatgaatcttctctgatctcacatggaactctgcaggagaaaagattctctgcctttctgtaaagtccctagtaaatgacactgtatatacatgagagtgagacttggttatagctacacatgcacacatacaaacacacaaaaagggcaggtgtcagagccttcttgtctgctccccctcttgaatccttggaacctaggtgtgagtgctatttcagtgcaacacacctattcaaggattcaaagaggctgagccttgtctacatgtagaaggaccaacaacctgtccccttctttcacatgtttgtgtttgctatgcggtgccagatcctgcactgggtggtggagatacaacggtaaataagacagctaaggtccctgggctctgtagagggcacctgtgggagaatgaaattcatcattgccctggacaagcttacacctctttgagagcatgagctttctgtttactcccagcttactatgtgtcagatactgtaatggggaaacacacattgggtgatgagacttgcacagccagtctttgctctcagtgagcttatagtttaccagagaaacagaagagaatgaagtatcccaattttctgtaccatcttccaacatgtgcatgtacatgtgtgcccacatacagtttgtcccaacctccttgctaggccccaaatacatccagcacctgcagaccctcaagtgtgatctgaaaaagatgccactcatatctttcattctagtctgaggttttgtctgagagggcatgtccatgtggccttgtgcagggggatgaatacatatgctatccctgaggagaggcatctgtcttagcaaatgcacacagagatactttgcaggaatgggaccatgaaagtcaaatatatatggagatatacatgcagggtgcaggtgcctgagtcttctgctctgctcttcctctctaatcctttgtccctgggtgagagtgctttctgaatgcaatgcacccgggcaaggattctgagagggtgagccccctctgcgtggagaacagaagatctgtatgtcacctctcagctgcttgctgcttgcctgcctgctctctgaccctcattcattctttccttccacaaataatatgtattgggcaccatgatgggcattggacacagagaaatgaacaaggcagacttcgcccctgccttcctggatattatagcctgagaggagaatggactttgtcaccactcattgcccctgcatatactgagggtgagtgggccacataggaacttcttatctaccctcttcccaccttaacccacccataagtgtgagtcttctcattcctgctgtcacattgatacttgtttcttgttttttccttctttccttccttccttcttttctttttctttctctttcttttctttctttccttcctttcctttcctttcttttcttctctcttttcttttctttcttttttgatggagtattgctctgttgctcaggctggagtgcactggcaccatcacagttcactgcagcctcaaccacctgggctcaagcgatcctcccacctcagcctctcaaatagctgggaccacaggcttgtgccaccatgcctggctaatttgtgtttattttttgtagagatggggtctcactatgttgcccaagctggtctcaaactcctaggctcaagcagtccaccagccttagcctcccaaagtgttgggattataggtgtgagccactgcacccagcctgatacttgtcgaagcaacttctctctactttagttcaatgcaaggttaatgcactaggcaagaacagcaagccttcttgttagatgcacatgtgaggtgtacaggtactggaatctcctgtcctggttccccctctctaatccttgctacctgggtgagagtgctttctgaatgcagtgcacccaggcaaggattctgcaagggggagtgacatcttcgcataggacagagcacttctacctcctccttccatcctttctatgactatttgttgagtacctacctactctattgcaggtgctgtcctgggcagttggcccacaagagaatgagccatatctggttccctaccttcatggagtgtacagttcagggaggagaatggactccttctcattcattatatctgcatgtcctgagggtgggtggggtacagggtgggtggggtacagatacatgttggagaatctactaaacctcagtacaatcacacataaatacgctgtgtgcaagagaaagggcctgacttggttacatccacagagacatgtcctcacagagtggtccctctgacctggtgcatcactcacattctttcagcctgtgtgccagtactgccttgactcactgtcccttttcaagaattccaagggaagaagccttgtctacacttaaaaggacagagcttttgcacatcaactctccctcctcttccttccacagatactcaagtgtctattagacagcaggtattatgttcatcaccaaggatatagcagggatcaaaatggacaggttgctaccctacattctggtagggactcataaacacactatacataaatgttgtggatgaataggccactgttcaaaagaatgaagtagatctatatgttccttgttacccagtctgcatgcacaagcatgtgcaggttctgctcaagtgaaattctcaaatgtccccaatccttgtacaccagacacactcagagacatggccctgcatgcagagaaccccacctactgaaagggtaggagatggagcctgttgtgctctcctctctcccattctcagcgtgcaagccagtgagcttccttaactcccttatagatggggattaaatgagggaagtcttcttactgctactttccttcttgctgctctgtataggagagatcctttcattacttttctgtacagtcacagatgaacacactatatgcggtgagccttccctgtaaacccatgtgagcacatgtgcacacacgcacacgtgcacacacacatactctgtatggctgcttgggccttcagtcctgttccccctcttgaatcctggtacctggatgcaagtgctgtgtcaatgcggtgcacccaggcaagcattccacggctgagccttttctgcatagagcgaagaacacctgtttataatccccatccttcattcattcccacctttaacaagcaggggtggcgctcctgtcatgcaccagacatggagagacagggtggtcaagaaagacacagaactcatactcacatgcctagtgagcatgtttaagagaaggaacttccgttgcccacattgttcatgcatacgtatgtagcagagagtgagtcttcccatcatcccctctccaaccccccaacagtgctcagctagagaactacaaaaggtgtgtctccccttacacagagctgcagccacagtgtgcataggataatgagtgtcattagcagcatcttctcactcatgtctggtgtgcaaggcaataggctttctacttgctgcttatgccaccagagcttgaaggaaagtggccctacttgtcagtcatctcacacatgcatatgaagaaaagacacttcacctttgtatggtcataggaaaatcacctgtgagccagagagtgctgtttcttttgtacatacacacaaacacaatggatttgaagatgctcgagccttctattcaggttgtccctctctttcattcttcgtagttgggtacaaatgctattccagtccattgccttgtacaaaaattcagagagggaatctcatccatgtttaaaagtgtagagtctttgcatcacccctctatgtcccattatttcatttctttaagttatgtatagagcagtggttctcagtgtggtccctgggccagcagcatctgtatcacctaggagcttgttcaaaatgccaattcttgggctcatccctgacctactacaccataaaccatggaaatctgtactttaccaaggctctcaactgattctgatgctcacttaagtttgagaatcactgatttagtataagtgctagctaggggcagtgataagctagtcaggtgaagggtggaagagaatgagctcctgcattgctcatgtacgttcccaatgccgagtccatgcagactgtggcagggaagccatcatttcattactgtctccacctcctccataaccacacattcagtgagcacatgaggctaagtgaacacacaacaagtactttattagggaatagacttggcactgcttctccaggcgtgcacctgacactttaatctcaatctgtctctctctcaatcaatcaatcaatctctctcctctctctctctttctctctttctgtctttctttctctctcctcccccacccccctcccatgtgcagaagaatgaactgctccttctcccatacccattgcatatcggagttgtgaattctcaaaacacctcctgtgtgcatggattacaggagggtgagccttgtcatcgtgaatcttctgctgaacaatccaagtagcccgtgtttattgcgcacttttgatgtgccatgagctgtgctgggagtaccctgctaaataatggacagtgtctctctccgggacttcctatctagtggaggtattaggtgcctagacttccccaggcctaggcaacagacacaggtgtgtcaggaattgagccttctcattctcttatgaatacacatgctcacattgtgcatgcatgtgcacacacacatgtgtaagtgtagaaacatttctgtacaaagctgaaaggaaggagccttattatctaaacttgcctgcaagtttccttgccacacacactcagatgcatgcctggtgtgcaggtgcctggactttgatttttgcttgccctttcctagccttgcagcctaggcacaagtgctgtcttagcagtgcaatgggcttgtgcaaggataccagcttgtgagccttgcctatgtgtaggacagagcctgtccatcccttctctttcctttgttcattctttcagtcagtcatttgtgtgtgcatgtttttggtccattcatttattcatccctttaacaaatttactgaattcctgctgtttgggaatgccacagtaaactaacctgtcagagatgccgaccttactgtctagcaggctcatggagaataagcatcctcatgtcatccaacttcctgtgaatacatgggctcagggtgccagaaatcaggcttttctttattccctcccacagacatgggtacctgtgcaaatatatgtggtgtgcacatcctgagcctgctgctctgcttccccttgtatccttgccacctaaatgtgcatgctgtctcagtgcagcacctattccaggactctcagaggggcctttttctgcccatagacagacaaagtgcctgtgagtcacacttcctcctccctctccttcccctctacctccctttcacaagtattgagcacttagtacatgctaacgctgtgctgccagggcagtgggcatatggtatcacacaagatggacttggttcttgcctcaaagaatatgtgtaggagacttgactttttgtcacctaatattcctgcacgtgctgagttagtgtgggccacaacatgggacttcttattgacaccctctcccaacatatacacaatgcaagactctcattcctgttctcacacagagctgtgtaacagagaaccttctctgcttcgagcacggcaggtgcccaagccttctgccctgctccccctctctaatccttgctatctgggtgctagtgctggctcaatgcaatgcacctgggcaaggattcagagagggggagctcaactgtaccaagaaggacagagagcctagacatcacccctcccaccctcccctgtcatagtttttgagtgatgggtgtgtgttggggaagcacagaacagaatagttagggacttcaggtgctctggtgggcttgtctgtgtattagaataaatgtccttattaaataatgtccatgtatgcaggtatccagagtgagacagtgagctttctctgtgttccccacctgctgtccacacacagggtggtgggcgggaaccagagccttctgatttgctccctcacttccttccaacctagatgtgagtgctgtctcaagtattaagccaaggattcaatgagatggagccttgcctacctatatgtatatatatggactgagtgcatatatgtctcttttcttgccttcctatatcttgagtttctagagtgtgacagatactctttttagtgttaaggatgcagtgacaaacgagagtcaaaatcactggatgtgctctctgatgggcagctttagaagaaaaattcagacgggcacaaatgatgggggccaaagagagagtcttcctattccccccactctgtcccctctgaggacagggagatgcacacattcatgaagatttacacttacagaatgtataggagtttgagcttataagctgccctttatcttccaggacatcctgagtagaactgtgagctgcctttagatgtctattacagactcttcttgaattagagggggtgaagagcaagggacccttcttattgctgatcttgtatgcaccccacacaatatggaaatgagaacagcctatatctttatattaccttactttagtcaaatagagatggactatacatgtctctgtttcagtctatcgctctctctgtccgtctctccatctctctctctctctcacctagggagtacaggtgcccatgatctgattcactcccctcctcccatccttagcgcctgagcctgagtgctttctactgtgacctcagcagtattcttcagttgttactctcttcttagctaagctgatctattcattcctccccatcttatcatttttgctcattgcccattgcaaatttatagtgttcaggtcagcgtagcaatacagtattataaatagtggtgacagagacagaaagagacacacactccatttcagtcctcaagttcttaaacatttgggacttatagattctgatccttggtccttcttctctcccagattctcccaatctaacctgcagtaaagattcaggttatttaatatgtgctccttatcttttgtatactctaaaatctcattttggttactgctcagccttagtcttattttatcagactttatacctctcttgatgcccaagactagcagcatcagcatcctccaggaacttgttagaaataaactttcaggcctcacctcagacctaggtaatcagaaagtcaggggtggggcccagcaatctgtgttttaacagccctccaggtgattctgatgcacactgaagtttgagaaccattggtttaaatgacttaaaatttctattctgtcattactagggggatttctgtgttacacaggatgatttttagcatcaaaatttccttatgtgtaaatggctcttttagtttcttttcatattttaaaaattcatagacttttttgagcagttttaggtttacaaaaagattgaatggaaagtatagagttgttatatattctcgagacaccccagtttccgctattaacatcttgcatgagtgttgtacacttgttaaaattgatgggctaatgttgagacattattattaaataatagtataattataatgtattataactattattaaataatagtttaaatataattattaatgtaaaccatagtttacattagagttccctctttgtgttatatactctatgggttttgacaagtgtataatgacatgcatgaccattatagtatcatacagaatagtttcactgccctaaaattcctctgagttctgcctatttatcccccctcccccaccctaaacccctggcaaccgctgatcatttttctgtctccatagtttagccttttccagaatgtcatatagttagaatcatacattatgcagccttttcagaatggcttattttacttagcactatgcatttaaggctcctcatatcttttcatgacttgatagctcatttcttttctttcatttttttccccatttatcccatatagtaaccagcttatttctttttatcactgcatagtattccattgtctggaggcacaaagtttatttatcctcacccactgaagggcagcttggttccttctacattttggcaattatgaataaagctgctataaacgtttgtgtgcaggatcttgtatggacataagttctcaactcacttaagtaaaataccaggaagtgttgctggatcatatggtaagactatgtttaattttgtaagaaaccaccaaactgtcctccaaagtggctgtaccattttacatttccatcagcagtgaacgagagttcctgttactccatatcctcatcaacatttggttttgttagtgttttggattttaggcattctaataggaatgttttcttatccttgagcttaaagagtttcttacttattttagatacaatccctttctaagatatgtcttttgcaaatatttttcccatgtgtgatttgcttttacattcaattaacagtggcttttgcagagcagaagtttttaattataatgaagtccagtctatcaattttttctttcatggatcatgcttttggtgttgtatctaaaaggtcaccaccaaacctaagatcacttagattttagcctacattattttctaggagttttatagttctgtgttttacatttaggtcagtcatctattttgagttaatttttgtgaaagttgaagacctacctctagattcgtttttttttttgcatgttcatgtccagttgtttcagtaccatttattgaaaagaatatatttgtgtcattgtattgcctttgctcatttgtcaaagatccattgactatatttttgtgggtatatttctggattttgttctgttctattgatctatattcttatgccattattacactgtcttgattattgtagctttatagtaagccttgaagttggatagtgtcagtcttccaggtttgttcttctctttcaaaattgtgttggctattctgggtcatttgtctctctggctaaactttagaatcagtttgttgatacccacaaaataacttgctggaattttgattggaactgcactgaacctgtagatcaagttgggaaaaacttacttcttgacaatattgagtcttcctatccaagttcatggaatatctatttatttagatctttgatttgtttcatctgagttttgtagttttcctcatgtaggtcttgtacatattttggttagttttatacttaattatttgatttttagaactaatgtaaatagcattgtgttctgatttttcaaattccagtttgtcattgctagtgtatgagaaagcagttgatttttgtatattaaccttatattctgcaaccttgctatagttactcatttgtttcaggagttgttgactctttggattttctacatcgacaatcatgtcatcagtgaaaaaaaagtttttatttctttctcccactctgtgtatcttttacttcccttccttgtcttttttgcattagctaggtctttcagtatgatgttgaaatgggttggtgagaagggatatccttgctttttgctaatgttgctggaaaagtcttgagtcttgtacaattaaatgttagctgtaggtttttgtagatgttctttatcaagttgaagaagttcccctctattcctagtttaattagagtttttatcgtgaatgggtgttgcgtattgtcaaatgtattttctatgttgatttatatgatcatgtgatttttcttcttaagcctgttaatatgctagattacgctaatttatttttgaatgttgaactagccttccataactgggataaatcccacttggtcatgatgtacatataattctttttatatattctcgtgctcaatttgctaatatgttcaggatttttgcatctatgttcatgggagatattggtctgtagtttagctttcttgtaatctctccattcagttttggtattagggtaatgaattaagaagggttccctttgcttctatcttctgaaagagattatagaaaactggtacaattttgtctttaaatgtttggtagaatacactagtgaatccatctgggtctagggctttctgtcttggaagtttatttattagtagtttagtttatttaatagatacatgtcttttcacatgatctgtttctccttgcatgagttttggtagattgtgtatttcaaggagaattgatccatttcatctgaattaatcaaatttgtgggcatcaaattgttaatattcctttattatctttttaatgaccatatgatcgatagtgatggtctctattttattttttccttaattatttttacattgacatgtaattatacatatttgtggggtacacagtgacattttaatacatacaatgtatcacaatcagatcacggtattattttgtaataccaaaatacaaaaagtaatttgtgccttctgtctttcatgcttactttttttttttctttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggctattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttctttccttgagcagtggtttgtagttctccttgaagaggtccttcacatcccttgtaagttggattcctattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgggggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttataggcatttagtgctataaatttccctctacacactgctttgaatgcgtcccagagattctggtatgtggtgtctttgttctctttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactgtgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtttcgttgatctgtctaatgttgacagtggggtgttaaagtctcccattattaatgtgtgggagtcttaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagttggttattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcccgaggcttctgcattcttcacgtagttctcgagccttggttttcagctccatcagctcctttaagcacttctctgtattggttattctagttatacattcttctaaattttttttaaagttttcaacttctttgcctttggtttgaatgtcctcccgtagctcagagtaatttgatcgtctgaagccttcttctctcagctcgtcaaaatcattctccatccagctttgttccattgctggtgaggaactgcgttcctttggaggaggagaggcgctctgcgtttcagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccccgctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccccctacattagccccttttcataacttttcttacaactttcacaatcttcaacatgccttaactttctgccttccttttacactcttcgttttcgtagtttcaccttctgtgtctttctttgatttctgtctcttccagtttctctcttacttactctttccatctatttatctctctctcatttgcactctgtttctctctctctctctgtcatcccgtttccttttcccctcctgagttctctggctcccaccaccggcaggcctttcatgcttacttaaccgggctagaggtttatcaattttattgatcttttcaacgagccagcttttggttttgttgactttctctgttgatgtcctgttttcagtttcattgatttctgctctaagttttattacttcttctcttctgcttactttggattcaattcttttaatttttttagttacctaaggtggaggcttagattattgattatagatctttcttctttattaatatatgcattcaatactataaatatccctctaagcactggtttcactgcatcccacaaattttgataagtggtttcttcattttcatttagttcaaaatgttttttaatttttctttagacttctttaacccatgtgatatttagaagagtgtttaatctccaagtatttgagttttcaagctttgtcttactgatttctagtctaattccattgtcctctgagagcatactttgcatgatttctgttcttttaaatttgttaaagtatgttttatggctcaaatgttttctgtcttagtgaatgttctgtgtgagcttgagaagaatatgtattctgctgttgttaaatgaagtgttttatagacatcaacttgatctagttgatggatgatgctgttcggtttacctgtgtctttactgatcttctgtctgctgtatctgtcaattactaatagaggggtggtgaagtctccaactataatagtacattcatctatttctccttgtatctctatcagtttttgcctcatatgttgacgctgttgttaggtgcttatttattagagattattatgtgtttttagagtattgacccctttatcattatgcagtacccctctttatcgctgataattttccctgctgtgaagtctgctctgtctgaaattaatatacctactccacatttgttttgactagtagtagcatgttatgtctatctctgtattcttgaagagatttctgaagatgtctgctgtaattctgtccttgctcctccataggtaaaaggtaaggtatttgttttaccccggcaactttgaagatttttttcctttgattttctgcagtttggatatgatatgcgtaggtatagatttttttgtattcatcctccttagtgttctgtgagcttcctgcctggacctgtggtttggtatctgtcattaatttggaacaattcttagtcattattactttatgtatttcttctatttctttctttctttctttctttctttttttttttgagacgaagtcttggcctgttgcccaggctggagtacaatggcttaatctcggctcactgcaacctctgcctcctgggttcaagtgattctcctgcctcagcctcctgagtagctgggagtacaggtgcgcaccaccatgcctggctaattttttgtatctttaggagagatgggatttcaccatgttggccaggctggttttgaactcctgacctcgtgatccgcccacctaggcctcccaaagtgctaggattacaggggtgagcaaccaaccacgcctggcttcttgtatttctttcttctccttctggtattccagttatatgtcttttgtaattgttccacagtccttggacattctgttccttttccattttctttctctttgaatttcagtttcagaagtttctgttgctatttcttccagcttgctcattctttctctgctgtgtccaatttattgatgaatcaatcaaaggcattctttatttctgttatggtgtttttgatttctagcatttccttttgattctttcttaagatttccatctctctgcttacattactcatctgctcttgcgtgttgtccactttttccattagggcctttagcatattaaacgtattttaaattgctgttataataattccaacattccttccatgtctgactctttatcttcatgcagtgtttttttttttttttgtcctttagtataccttgtatttttttgttgaaagctagacatgatatactaggtaaaagtgactgaggtaaatagacctttagtataaggtttatgtttatctggataggagttaggctgtgtttacatttgttgtaactaaatgtgtcagaggctaagatttccactagtgtctgtttttgactgttgtgtatttgggtttccatttccctagagacttcttaactaaatttaaaaggtacagttctttcagtcatattcccctgttattatacaggatctctatagaagtaatgataaaatgttgagagaatggaagcattctgtagtcatatgattaggtttcagttttttagtgagcctgtgccctcagttatgactttgaaaagtgcttctccctttcgttttgttttttccccacttaggtaagatagaaaggctggtgggagatagaattagatactgactttttcccaagttgattaggccctggtaaaatagtttttcatgaaggtatgccttataagaaaaaccaaatgctctggttataattgtaaaatgactgtttcccctccccctgctggaagcagaaagagctttttctctgatcttcactgtaagaacaagaatgttttaggactcctggaggtaaaactcttcaaagtgtgaggtccccctaagactgggctccctggagtttttaagcttttgagcttatccacactcagcctcctcagttatagttaggttttcctaccccagagaacctaaactgtaagtttctgtttgtgttcctatggaggtttctgttcatgtaagctatgagtctgtatccatctgtctctttctctaattttgggggaagcagtttgccctgtgatctcagttctctgatggagctgagaagagttgttgatttccagtttgtattgtggggatgggagtgatgacttccaagcttcttttacagtggacttgaaactggaagtcatactttgatttttacttggatatttgcatccaccttttccttagcctttatcagtgatgatgcagatatgtcctttttctgttcctttcacttcattttattgcatacattccctgatgcaagaagttatttctttattttagtatatatgaattaatcaattttttgtctttctggatcagaactaattttgtctgttcacatctgggacaaatatactattctatgttttttaaaaaatcaacttttaaaaaacccatctggaatgtttgcactgtggtacatgttgtaattctatattccccatttcgataccaagcgattcctcaactatttactaaaaagtgagtatttccttatatttgtgttgcttctgatttagcaactattaagttcaaatagtttggatccattgctaaactttctattctttttttttatttaagttttagggtacatgtgcacaacgtgcaggtttgttacatatgtatacatgtgtcatgttggtgtgctgcacccattaacttgtcatttagcattaggtatatctcctaatgctatctctcccccctcccccgaccccacaacagtccacggtgtgtgatgttccccttcctgtgtccatgtgttctctttgttcaattcccacctatgagtgagaacatgcggtgtttggttgtttgtccttgcaatagtttgctgagaatgatggtttccagcttcatccatgtccctacaaaggacatgaactcatcattttttatggctgcatagtattccatggtgtatatgtgccacattttcttaatccagtctgtcattgttggacatttgggttggttccaatgaacagacacttctcaaaagaagacatttatatgcagccaaaaaacacatgaaaaaagctcaccatcactggccatcagagaaatgcaaatcaaaaccacaatgagataccatctcacaccagttagaatggcaatcattaaaaagtcaggaaacaacaggtgctggagaggatgtagagaaataggaacacttttacactgttggtgggactgtaaagtagttcaaccgttgtggaagttggtgtggcgattcctcagggatctagaaatagaaataccatttgacccagccatcccattactgggtatatacccaaaggattataaatcatgctgctataaagacacatgcacacatatgtttattgcggcactattcacaataactttctattcttaccccagtgccataaggttttgatgattgcttctttgtagaagaccaaaatctacagataaatttgccatatttacatttaaggaaatacatatactagtatctgtgtctacttattcttctagatgaatatcactaccagtctgtcaagttatataaaagatgccacggggactttagattaatatatagatgtaacataattcaaattagagtctatttcattcttgctatatttagactttccaatcaagagcataatacatctctgttgatttatatcttccttttttcattcttatttgtctttttataaattttaaagtaatactgtgtttcagtatgtctccatcatatatgaattcttttatcattatattttctagttctatggttatatgtaggaatgcagtttttagtagatttacctcctaatttatgagttcatatattacttttggctatttttagttggtatttttgtagttgtataggtatgcattcatgtaatccaaactggaataccatatatcttccttttctatacgcattcctcatttttgtccttttaaagcttttcttgtaccgtgttaaatataattggcaacaagaagtatcatgccttcctgtattaaggggaatggtatttgcttcttggttttttaatttagatattctacatcatgtcaagaaagaaatcctctacatggaacattttaaacttttaaatacagaatgactgtaaatttaaaaatcaattcctgacatctgttgagataagataattatggatttaaaatttttatctgttaatctgataacttatgttggtagtttcccatgtgataccggtcttgcattcctggaataattccttcttatatatagcaggcaaatctttcaaggtgatgctatatttagtttgttaaagttttatttaggagttttgcatgtatgttccaaagtgaaagtgatctttacatttctagtgttgtcttcgtcaggcctggtagacccttgtccttgatcctccagggtgcttctctacacttcacatttatgacactcttgaaagcctgtataacagggtatttcttatcatatctgaagaatctctgagatagcaccaaagaaaagctgattagctaagggaacatagcatattattgttttaattttaatttacctgaatttttaaagccattaaaaaacaaattatctaccaatgtattttgcctattcatctattagaatccaattttaatgattcaaacaatctctctctataggctgttactcctttgggcgaatttacagaaaatattagtttatttgcttcactttcccagctgtccacatggtctcttctgactggtttgtcctcttcctctttctcatcaactgtgggtgttgcccaagtacaatttgtccatgctgagttctttctttacttcagacattctcacagtatagtctgtgagttattgagacccttttagggggtctttaaggtcaaaactattttcatattaagatattatttgccttttttactcattttctcatgaatatacagtggaattttctgcagactgtagtatgggtgaagatgtcattcctctgagaactagtagaatatgttaagcagaatccagtaatcctctattaacccagacatttgagtattgtgacatttaaataaatcattgtatattttaaacatttttccattttaatttctttattattattattattatactttaagttttagggtacatgtgcacaatgtgcaggttagttacatatgtatacatgtgccatgctggtgtgctgcacccattaactcgtcatttagcattaggtgtatttcctaatgctatccctcccccctccccccaccccacaacagtccccagagtgtgatgttccccttgctgtgtccatgtgttctcattgttcaattcccacctatgagtgagaatgtgtggtgtttggttttttgttcttgcgatagtttactgagaatgatgatttccaatttcatccatgtccctacaaagaacatgaactcatcattttttatggctgcatagtattccatggtgtatatgtgccacattttcttaatccagtctatcattgttggacatctgggttggttccaagtctttgctattgtgaatagtgccgcaataaacatacatgtgcatgtgtctttatagcagcatgatttatagtcctttgggtatatacccagtaatgggatggctcggtcaaatggtatttctcgttctagattcctgaggaatcgccacactgacttccacaatggttgaactagtttacagtcccaccaacagtgaaaaagtgttcctatttctccacatcctctccagcacctgttgtttcctgactttttaatgattgccattctaactggtgtgagatggtatctcattgtggttttgatttgcatttctctgatggccggtgttggtgagcattttttcatgtgttttttggctgcataaatgtcttcttttgagaagtgtctgttcatgtcctttgcccactttttgatggggttgtttgtttttttcttgtaaatttgtttgagttcattgtacattctggatattagccctttgtcagatgagtaggttgcgaaaattttctcccattttgtaggttgcctgttcactctgatggtagtttcttttgctgtgcggaagctcttgagtttaattagatcccatttgtcaattttggcttttgttgccattgcttttggtgttttggacatgaagtccttgcccatgcctatgtcctgaatggtattgcctaggttttcttctagggtttttatggttttaggtctaacgtttaagtctttaatccatcttgaattaatttttgtataaggtgtaaggaagagatccagtttcagctttctacatatggctagccagttttcccagcaccatttattaactagggaatcctttccccattgcttgtttttgtcaggtttgtcaaagatcagatagttgtagatatgcggcgttatttctgagggctctgttctgttccattgatctatatctctgttttggtaccagtaccatgctgttttggggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaagatacaaaatcaatgtacaaaaatcacaa
